(12) United States Patent
Zhang et al.

(10) Patent No.: US 12,466,884 B2
(45) Date of Patent: Nov. 11, 2025

(54) TISSUE-SPECIFIC WNT SIGNAL ENHANCING MOLECULES AND USES

(71) Applicant: Surrozen Operating, Inc., South San Francisco, CA (US)

(72) Inventors: Zhengjian Zhang, Albany, CA (US); Yang Li, Mountain View, CA (US); Wen-Chen Yeh, Belmont, CA (US); Tom Zhiye Yuan, Union City, CA (US); Helene Baribault, Redwood City, CA (US); Kuo-Pao Lai, South San Francisco, CA (US)

(73) Assignee: Surrozen Operating, Inc., South San Francisco, CA (US)

( * ) Notice: Subject to any disclaimer, the term of this patent is extended or adjusted under 35 U.S.C. 154(b) by 1214 days.

(21) Appl. No.: 17/257,820

(22) PCT Filed: Jul. 9, 2019

(86) PCT No.: PCT/US2019/041067
§ 371 (c)(1),
(2) Date: Jan. 4, 2021

(87) PCT Pub. No.: WO2020/014271
PCT Pub. Date: Jan. 16, 2020

(65) Prior Publication Data
US 2021/0380678 A1  Dec. 9, 2021

Related U.S. Application Data

(60) Provisional application No. 62/822,731, filed on Mar. 22, 2019, provisional application No. 62/770,026, filed on Nov. 20, 2018, provisional application No. 62/695,509, filed on Jul. 9, 2018.

(51) Int. Cl.
*C07K 16/28* (2006.01)
*A61P 1/16* (2006.01)
*C07K 14/47* (2006.01)

(52) U.S. Cl.
CPC .............. *C07K 16/28* (2013.01); *A61P 1/16* (2018.01); *C07K 14/47* (2013.01); *C07K 2317/565* (2013.01); *C07K 2317/622* (2013.01); *C07K 2319/81* (2013.01)

(58) Field of Classification Search
CPC .. C07K 16/28; C07K 14/47; C07K 2317/565; C07K 2317/622; C07K 2319/81; A61P 1/16
See application file for complete search history.

(56) References Cited

U.S. PATENT DOCUMENTS

| | | |
|---|---|---|
| 8,278,036 B2 | 10/2012 | Kariko et al. |
| 8,507,442 B2 | 8/2013 | Gurney et al. |
| 8,691,966 B2 | 4/2014 | Kariko et al. |
| 8,748,089 B2 | 6/2014 | Kariko et al. |
| 8,835,108 B2 | 9/2014 | Kariko et al. |
| 8,969,526 B2 | 3/2015 | Baehner et al. |
| 9,296,826 B2 | 3/2016 | Cong et al. |
| 9,771,427 B2 | 9/2017 | Hofer et al. |
| 11,958,891 B2 | 4/2024 | Zhang et al. |
| 11,993,645 B2 | 5/2024 | Luca et al. |
| 12,240,876 B2 | 3/2025 | Li et al. |
| 2003/0044409 A1 | 3/2003 | Carson et al. |
| 2007/0244061 A1 | 10/2007 | Niehrs et al. |
| 2008/0038272 A1 | 2/2008 | Buehring et al. |
| 2008/0267955 A1 | 10/2008 | Schluesener et al. |
| 2010/0092457 A1 | 4/2010 | Aburatani et al. |
| 2010/0172895 A1 | 7/2010 | Boone et al. |
| 2013/0230521 A1 | 9/2013 | Nakamura et al. |
| 2014/0044713 A1 | 2/2014 | De Lau et al. |
| 2014/0105917 A1 | 4/2014 | Gurney |
| 2014/0328859 A1 | 11/2014 | Cong et al. |
| 2015/0299324 A1 | 10/2015 | Hofer et al. |
| 2016/0303232 A1 | 10/2016 | Adiwijaya et al. |
| 2017/0158775 A1 | 6/2017 | Linden et al. |
| 2017/0240633 A1 | 8/2017 | Wang et al. |
| 2017/0306029 A1 | 10/2017 | Garcia et al. |
| 2017/0349659 A1 | 12/2017 | Garcia et al. |
| 2018/0066067 A1 | 3/2018 | Cong et al. |
| 2018/0312604 A1 | 11/2018 | Throsby et al. |
| 2020/0024338 A1 | 1/2020 | Luca et al. |
| 2020/0048324 A1 | 2/2020 | Zhang et al. |
| 2020/0199237 A1 | 6/2020 | Garcia et al. |
| 2020/0199238 A1 | 6/2020 | Garcia et al. |
| 2020/0308287 A1 | 10/2020 | Li et al. |
| 2021/0079089 A1 | 3/2021 | Li et al. |
| 2021/0087280 A1 | 3/2021 | Li et al. |

(Continued)

FOREIGN PATENT DOCUMENTS

| | | |
|---|---|---|
| CN | 104080471 A | 10/2014 |
| CN | 104704001 A | 6/2015 |

(Continued)

OTHER PUBLICATIONS

Grainger & Willert. Wiley Interdiscip Rev Syst Biol Med. 10(5):e1422 (2018)) (Year: 2018).*
Almagro et. al., Front. Immunol. 2018; 8:1751 (Year: 2018).*
Rudikoff et al., Proc. Nat'l Acad. Sci. USA, 79:1979-83 (1982) (Year: 1982).*
Brown et al., J. Immunol., 156(9):3285-91 (1996) (Year: 1996).*
Chiu et al., Antibodies, 8(55):1-80. (2019) (Year: 2019).*
Witzigmann et. al. Hepatology Research. 46:686-696 (2016) (Year: 2016).*
Apte, U. et al. (Sep. 2009) Beta-catenin activation promotes liver regeneration after acetaminophen-induced injury. The American Journal of Pathology. 175(3):1056-1065. DOI: 10.2353/ajpath.2009.080976.

(Continued)

*Primary Examiner* — Meera Natarajan
*Assistant Examiner* — Francesca Edgingtongiordano
(74) *Attorney, Agent, or Firm* — Cooley LLP

(57) ABSTRACT

The present disclosure provides tissue-specific Wnt signal enhancing molecules, and related methods of using these molecules to increase Wnt signaling in liver tissues.

11 Claims, 109 Drawing Sheets

Specification includes a Sequence Listing.

(56) References Cited

U.S. PATENT DOCUMENTS

| | | |
|---|---|---|
| 2021/0292422 A1 | 9/2021 | Li |
| 2021/0403578 A1 | 12/2021 | Garcia et al. |
| 2022/0064337 A1 | 3/2022 | Li et al. |
| 2022/0112278 A1 | 4/2022 | Li et al. |
| 2022/0175884 A1 | 6/2022 | Lee et al. |
| 2022/0195053 A1 | 6/2022 | Li et al. |
| 2023/0138045 A1 | 5/2023 | Li |
| 2023/0183359 A1 | 6/2023 | Garcia et al. |
| 2023/0374090 A1 | 11/2023 | Li et al. |
| 2024/0279303 A1 | 8/2024 | Zhang et al. |
| 2025/0171509 A1 | 5/2025 | Li et al. |

FOREIGN PATENT DOCUMENTS

| | | | |
|---|---|---|---|
| CN | 106714831 A | 5/2017 | |
| CN | 108602888 A | 9/2018 | |
| EP | 2305274 A1 | 4/2011 | |
| EP | 2331136 B1 | 1/2018 | |
| WO | WO-2008093646 A1 | 8/2008 | |
| WO | WO-2010090513 A2 | 8/2010 | |
| WO | WO-2010092457 A1 | 8/2010 | |
| WO | WO-2011130624 A2 | 10/2011 | |
| WO | WO-2012014076 A2 | 2/2012 | |
| WO | WO-2012045075 A1 | 4/2012 | |
| WO | WO-2012138453 A1 | 10/2012 | |
| WO | WO-2012140274 A2 | 10/2012 | |
| WO | WO-2013052523 A1 | 4/2013 | |
| WO | WO-2013054307 A2 | 4/2013 | |
| WO | WO-2013071047 A1 | 5/2013 | |
| WO | WO-2013078199 A2 | 5/2013 | |
| WO | WO-2013130364 A1 | 9/2013 | |
| WO | WO-2013151666 A2 | 10/2013 | |
| WO | WO-2014023709 A1 | 2/2014 | |
| WO | WO-2014081507 A1 | 5/2014 | |
| WO | WO-2014093924 A1 | 6/2014 | |
| WO | WO-2014164253 A1 | 10/2014 | |
| WO | WO-2015164392 A2 | 10/2015 | |
| WO | WO-2016040895 A1 | 3/2016 | |
| WO | WO-2016073906 A2 | 5/2016 | |
| WO | WO-2016081640 A1 | 5/2016 | |
| WO | WO-2017069628 A2 | 4/2017 | |
| WO | WO-2017100467 A2 | 6/2017 | |
| WO | WO-2018098363 A2 * | 5/2018 | ................ A61P 7/04 |
| WO | WO-2018107116 A1 | 6/2018 | |
| WO | WO-2018132572 A1 | 7/2018 | |
| WO | WO-2018140821 A1 | 8/2018 | |
| WO | WO-2018203567 A1 | 11/2018 | |
| WO | WO-2018215614 A1 | 11/2018 | |
| WO | WO-2019126398 A1 | 6/2019 | |
| WO | WO-2019126399 A1 | 6/2019 | |
| WO | WO-2019126401 A1 | 6/2019 | |
| WO | WO-2020010308 A1 | 1/2020 | |
| WO | WO-2020014271 A1 | 1/2020 | |
| WO | WO-2020132356 A1 | 6/2020 | |
| WO | WO-2020167848 A1 | 8/2020 | |
| WO | WO-2020185960 A1 | 9/2020 | |
| WO | WO-2020206005 A1 | 10/2020 | |
| WO | WO-2020250156 A1 | 12/2020 | |
| WO | WO-2021003054 A1 | 1/2021 | |
| WO | WO-2021173726 A1 | 9/2021 | |
| WO | WO-2022104280 A1 | 5/2022 | |
| WO | WO-2022192445 A1 | 9/2022 | |
| WO | WO-2023044348 A1 | 3/2023 | |
| WO | WO-2023115048 A1 | 6/2023 | |

OTHER PUBLICATIONS

Arumugam, T. et al. (Apr. 2015) "New Blocking Antibodies against Novel AGR2-C4.4A Pathway Reduce Growth and Metastasis of Pancreatic Tumors and Increase Survival in Mice" Molecular Cancer Therapeutics, 14(4):941-951.

Bhanot, P. et al. (Jul. 18, 1996) "A new member of the frizzled family from Drosophila functions as a Wingless receptor" Nature, 382:225-230.

Bhushan, B. et al. (Nov. 2014) Pro-regenerative signaling after acetaminophen-induced acute liver injury in mice identified using a novel incremental dose model. The American Journal of Pathology. 184(11):3013-3025. DOI: 10.1016/i.aipath.2014.07.019.

Brott, B.K. and S.Y. Sokol (Sep. 2002) "Regulation of Wnt/LRP Signaling by Distinct Domains of Dickkopf Proteins" Mol Cell Biol, 22(17):6100-6110.

Clevers, H. et al. (Oct. 3, 2014) "An integral program for tissue renewal and regeneration: Wnt signaling and stem cell control" Science, 346(6205):1248012-1-1248012-7.

Colman P. M., "Effects of Amino Acid Sequence Changes on Antibody-Antigen Interactions," Biomolecular Research Institute, Jan. 1994, vol. 145, No. 1, pp. 33-36.

D'Souza, A.A. et al. (2015) "Asialoglycoprotein receptor mediated hepatocyte targeting—Strategies and applications", Journal of Controlled Release, 203:126-139.

Eppink, B. et al. (Dec. 1, 2015) "Abstract C21: Generation of Wnt- and mitogenic receptor binding bispecific antibodies to target cancer stem cells" AACR-NCI-EORTC International Conference: Molecular Targets and Cancer Therapeutics; Nov. 5-9, 2015; Boston, MA. Molecular Cancer Therapeutics, 14(12 Suppl 2):Abstract C21, DOI:10.1158/1535-7163.TARG-15-C21; 1 page.

Ettenberg S.A. et al. (Aug. 3, 20101) "Inhibition of tumorigenesis driven by different Wnt proteins requires blockade of distinct ligand-binding regions by LRP6 antibodies" Proc Natl Acad Sci USA, 107(35):15473-15478.

GenBank Accession No. AF177394.2 "*Homo sapiens* dickkopf-1 (DKK-1) mRNA, complete cds" Dec. 20, 2016, 2 pages.

GenBank Accession No. AF177395.1 "*Homo sapiens* dickkopf-2 (DKK-2) mRNA, complete cds" Dec. 20, 2016, 2 pages.

GenBank Accession No. NM_001466.4 "*Homo sapiens* frizzled class receptor 2 (FZD2), mRNA" Feb. 17, 2021, 5 pages.

GenBank Accession No. NM_002335.2 "*Homo sapiens* low density lipoprotein receptor-related protein 5 (LRP5), mRNA" May 3, 2014, 5 pages.

GenBank Accession No. NM_002336.2 "*Homo sapiens* LDL receptor related protein 6 (LRP6), mRNA" Oct. 20, 2018, 8 pages.

GenBank Accession No. NM_003391.3 "*Homo sapiens* Wnt family member 2 (WNT2), transcript variant 1, mRNA" Feb. 17, 2021, 4 pages.

GenBank Accession No. NM_003392.7 "*Homo sapiens* Wnt family member 5A (WNT5A), transcript variant 1, mRNA" Feb. 21, 2021, 5 pages.

GenBank Accession No. NM_003393.4 "*Homo sapiens* Wnt family member 8B (WNT8B), mRNA" Mar. 7, 2021, 4 pages.

GenBank Accession No. NM_003394.4 "*Homo sapiens* Wnt family member 10B (WNT10B), mRNA" Feb. 16, 2021, 4 pages.

GenBank Accession No. NM_003395.4 "*Homo sapiens* Wnt family member 9A (WNT9A), mRNA" Feb. 16, 2021, 4 pages.

GenBank Accession No. NM_003396.3 "*Homo sapiens* Wnt family member 9B (WNT9B), transcript variant 1, mRNA" Feb. 16, 2021, 4 pages.

GenBank Accession No. NM_003468.4 "*Homo sapiens* frizzled class receptor 5 (FZD5), mRNA" Feb. 18, 2021, 6 pages.

GenBank Accession No. NM_003505.2 "*Homo sapiens* frizzled class receptor 1 (FZD1), mRNA" Nov. 22, 2020, 4 pages.

GenBank Accession No. NM_003506.4 "*Homo sapiens* frizzled class receptor 6 (FZD6), transcript variant 1, mRNA" Feb. 16, 2021, 5 pages.

GenBank Accession No. NM_003507.2 "*Homo sapiens*frizzled class receptor 7 (FZD7), mRNA" Feb. 21, 2021, 5 pages.

GenBank Accession No. NM_003508.3 "*Homo sapiens* frizzled class receptor 9 (FZD9), mRNA" Feb. 17, 2021, 5 pages.

GenBank Accession No. NM_004185.4 "*Homo sapiens* Wnt family member 2B (WNT2B), transcript variant WNT-2B1, mRNA" Feb. 13, 2021, 4 pages.

GenBank Accession No. NM_004625.4 "*Homo sapiens* Wnt family member 7A (WNT7A), mRNA" Feb. 17, 2021, 5 pages.

GenBank Accession No. NM_004626.3 "*Homo sapiens* Wnt family member 11 (WNT11), mRNA" Feb. 17, 2021, 4 pages.

(56) References Cited

OTHER PUBLICATIONS

GenBank Accession No. NM_005430.4 "*Homo sapiens* Wnt family member 1 (WNT1), mRNA" Feb. 21, 2021, 4 pages.
GenBank Accession No. NM_006522.4 "*Homo sapiens* Wnt family member 6 (WNT6), mRNA" Feb. 16, 2021, 4 pages.
GenBank Accession No. NM_007197.4 "*Homo sapiens* frizzled class receptor 10 (FZD10), mRNA" Mar. 2, 2021, 5 pages.
GenBank Accession No. NM_012193.4 "*Homo sapiens* frizzled class receptor 4 (FZD4), mRNA" Mar. 16, 2021, 6 pages.
GenBank Accession No. NM_014419.4 "*Homo sapiens* dickkopf like acrosomal protein 1 (DKKL1), transcript variant 1, mRNA" Feb. 18, 2021, 4 pages.
GenBank Accession No. NM_014420.3 "*Homo sapiens* dickkopf WNT signaling pathway inhibitor 4 (DKK4), mRNA" Feb. 15, 2021, 4 pages.
GenBank Accession No. NM_014421.3 "*Homo sapiens* dickkopf WNT signaling pathway inhibitor 2 (DKK2), mRNA" Feb. 13, 2021, 4 pages.
GenBank Accession No. NM_015881.6 "*Homo sapiens* dickkopf WNT signaling pathway inhibitor 3 (DKK3), transcript variant 1, mRNA" Feb. 23, 2021, 5 pages.
GenBank Accession No. NM_016087.2 "*Homo sapiens* Wnt family member 16 (WNT16), transcript variant 2, mRNA" Jan. 18, 2021, 4 pages.
GenBank Accession No. NM_024494.2 "*Homo sapiens* Wnt family member 2B (WNT2B), transcript variant WNT-2B2, mRNA*Homo sapiens* Wnt family member 2B (WNT2B), transcript variant WNT-2B2, mRNA" Nov. 12, 2018, 4 pages.
GenBank Accession No. NM_025216.3 "*Homo sapiens* Wnt family member 10A (WNT10A), mRNA" Feb. 17, 2021, 4 pages.
GenBank Accession No. NM_030753.5 "*Homo sapiens* Wnt family member 3 (WNT3), mRNA" Mar. 2, 2021, 4 page.
GenBank Accession No. NM_030761.5 "*Homo sapiens* Wnt family member 4 (WNT4), mRNA" Feb. 15, 2021, 4 pages.
GenBank Accession No. NM_031866.3 "*Homo sapiens* frizzled class receptor 8 (FZD8), mRNA" Mar. 16, 2021, 5 pages.
GenBank Accession No. NM_032642.3 "*Homo sapiens* Wnt family member 5B (WNT5B), transcript variant 1, mRNA" Mar. 22, 2021, 4 pages.
GenBank Accession No. NM_033131.4 "*Homo sapiens* Wnt family member 3A (WNT3A), mRNA" Mar. 2, 2021, 4 pages.
GenBank Accession No. NM_058238.3 "*Homo sapiens* Wnt family member 7B (WNT7B), mRNA" Feb. 16, 2021, 4 pages.
GenBank Accession No. NM_058244.4 "*Homo sapiens* Wnt family member 8A (WNT8A), transcript variant 3, mRNA" Feb. 23, 2021, 4 pages.
GenBank Accession No. NM_145866.2 "*Homo sapiens* frizzled class receptor 3 (FZD3), transcript variant 2, mRNA" Feb. 21, 2021, 7 pages.
GenBank Accession No. NP_001017403.1 "leucine-rich repeat-containing G-protein coupled receptor 6 isoform 1 precursor [*Homo sapiens*]" Mar. 2, 2021, 6 pages.
GenBank Accession No. NP_001017404.1 "leucine-rich repeat-containing G-protein coupled receptor 6 isoform 3 [*Homo sapiens*]" Mar. 3, 2021, 4 pages.
GenBank Accession No. NP_001025042.2 "R-spondin-4 isoform 1 precursor [*Homo sapiens*]" Dec. 12, 2020, 3 pages.
GenBank Accession No. NP_001033722.1 "R-spondin-1 isoform 1 precursor [*Homo sapiens*]" Feb. 20, 2021, 3 pages.
GenBank Accession No. NP_001035096.1 "R-spondin-4 isoform 2 precursor [*Homo sapiens*]" Dec. 12, 2020, 3 pages.
GenBank Accession No. NP_001193927.1 "E3 ubiquitin-protein ligase ZNRF3 isoform 1 precursor [*Homo sapiens*]" Feb. 17, 2021, 3 pages.
GenBank Accession No. NP_001229838.1 "R-spondin-1 isoform 2 [*Homo sapiens*]" Feb. 19, 2021, 3 pages.
GenBank Accession No. NP_001229839.1 "R-spondin-1 isoform 3 precursor [*Homo sapiens*]" Feb. 20, 2021, 3 pages.
GenBank Accession No. NP_001264155.1 "leucine-rich repeat-containing G-protein coupled receptor 5 isoform 2 precursor [*Homo sapiens*]" Mar. 22, 2021, 4 pages.
GenBank Accession No. NP_001264156.1 "leucine-rich repeat-containing G-protein coupled receptor 5 isoform 3 precursor [*Homo sapiens*]" Mar. 22, 2021, 4 pages.
GenBank Accession No. NP_001269792.1 "R-spondin-2 isoform 2 precursor [*Homo sapiens*]" Feb. 22, 2021, 3 pages.
GenBank Accession No. NP_001292473.1 "E3 ubiquitin-protein ligase RNF43 isoform 1 precursor [*Homo sapiens*]" Dec. 30, 2020, 4 pages.
GenBank Accession No. NP_001292474.1 "E3 ubiquitin-protein ligase RNF43 isoform 2 [*Homo sapiens*]" Feb. 14, 2021, 3 pages.
GenBank Accession No. NP_001304871.1 "R-spondin-2 isoform 3 [*Homo sapiens*]" Feb. 23, 2021, 3 pages.
GenBank Accession No. NP_001333361.1 "leucine-rich repeat-containing G-protein coupled receptor 4 isoform 2 precursor [*Homo sapiens*]" Mar. 16, 2021, 3 pages.
GenBank Accession No. NP_001662.1 "asialoglycoprotein receptor 1 isoform a [*Homo sapiens*]" Feb. 16, 2021, 3 pages.
GenBank Accession No. NP_003658.1 "leucine-rich repeat-containing G-protein coupled receptor 5 isoform 1 precursor [*Homo sapiens*]" Mar. 22, 2021, 4 pages.
GenBank Accession No. NP_036374.1 "dickkopf-related protein 1 precursor [*Homo sapiens*]" Mar. 3, 2021, 3 pages.
GenBank Accession No. NP_055236.1 "dickkopf-related protein 2 precursor [*Homo sapiens*]" Feb. 13, 2021, 3 pages.
GenBank Accession No. NP_060233.3 "E3 ubiquitin-protein ligase RNF43 isoform 1 precursor [*Homo sapiens*]" Dec. 15, 2020, 4 pages.
GenBank Accession No. NP_060960.2 "leucine-rich repeat-containing G-protein coupled receptor 4 isoform 1 precursor [*Homo sapiens*]" Mar. 16, 2021, 5 pages.
GenBank Accession No. NP_067649.2 "leucine-rich repeat-containing G-protein coupled receptor 6 isoform 2 [*Homo sapiens*]" Mar. 2, 2021, 4 pages.
GenBank Accession No. NP_115549.2 "E3 ubiquitin-protein ligase ZNRF3 isoform 2 [*Homo sapiens*]" Feb. 21, 2021, 3 pages.
GenBank Accession No. NP_116173.2 "R-spondin-3 precursor [*Homo sapiens*]" Mar. 16, 2021, 4 pages.
GenBank Accession No. NP_550436.1 "asialoglycoprotein receptor 2 isoform c [*Homo sapiens*]" Feb. 13, 2021, 3 pages.
GenBank Accession No. NP_848660.3 "R-spondin-2 isoform 1 precursor [*Homo sapiens*]" Feb. 16, 2021, 3 pages.
GenBank Accession No. XP_005582755.1 "Predicted: asialoglycoprotein receptor 1 isoform X1 [*Macaca fascicularis*]" Jan. 25, 2016, 2 pages.
GenBank Accession No. XP_006710646.1 "R-spondin-1 isoform X1 [*Homo sapiens*]" Feb. 28, 2021, 1 page.
GenBank Accession No. XP_011515320.1 "R-spondin-2 isoform X1 [*Homo sapiens*]" Feb. 28, 2021, 2 pages.
GenBank Accession No. XP_011515321.1 "R-spondin-2 isoform X2 [*Homo sapiens*]" Feb. 28, 2021, 2 pages.
GenBank Accession No. XP_011523257.1 "E3 ubiquitin-protein ligase RNF43 isoform X1 [*Homo sapiens*]" Feb. 28, 2021, 2 pages.
GenBank Accession No. XP_011523258.1 "E3 ubiquitin-protein ligase RNF43 isoform X2 [*Homo sapiens*]" Feb. 28, 2021, 2 pages.
GenBank Accession No. XP_016868884.1 "R-spondin-2 isoform X3 [*Homo sapiens*]" Feb. 28, 2021, 1 page.
GenBank Accession No. XP_016880289.1 "E3 ubiquitin-protein ligase RNF43 isoform X1 [*Homo sapiens*]" Feb. 28, 2021, 2 pages.
Gong, Y. et al. (2010) "Wnt Isoform-Specific Interactions with Coreceptor Specify Inhibition or Potentiation of Signaling by LRP6 Antibodies" PLoS One, 5(9):e12682, doi:10.1371/journal.pone. 0012682; 17 pages.
Hao, H.-X. et al. (May 10, 2012) "ZNRF3 promotes Wnt receptor turnover in an R-spondin-sensitive manner" Nature, 485(7397):195-200.
Heupel, W-M. et al. (Aug. 1, 2008) "Pemphigus Vulgaris IgG Directly Inhibit Desmoglein 3-Mediated Transinteraction" Journal of Immunology, 181(3):1825-1834.

(56) References Cited

OTHER PUBLICATIONS

Hombach, A.A. et al. (Jan. 1, 2012) "Antibody-IL 2 fusion proteins for tumor targeting" Antibody Engineering: Methods and Protocols, 2nd Ed. Methods in Molecular Biology, vol. 907, p. 611-626.

Ingham, P. W. (Oct. 1996) "Has the quest for a Wnt receptor finally frizzled out?" Trends Genet, 12(10):382-384.

International Preliminary Report on Patentability for International Application No. PCT/US2019/041067, mailed Jan. 12, 2021, 10 pages.

International Search Report and Written Opinion for Application No. PCT/US2019/041067, mailed Dec. 3, 2019, 16 pages.

Invitation to Pay Fees for Application No. PCT/US2019/041067, mailed Oct. 8, 2019, 3 pages.

Jacobsen, B. et al. (Oct. 10, 2014) "C4.4A as a biomarker in pulmonary adenocarcinoma and squamous cell carcinoma" World Journal of Clinical Oncology, 5(4):621-632.

Jacobsen, F.W. et al. (Feb. 3, 2017) "Engineering an IgG Scaffold Lacking Effector Function with Optimized Developability" J Biol Chem, 292:1865-1875.

Janda, C.Y. et al. (May 11, 2017) "Surrogate Wnt agonists that phenocopy canonical Wnt and β-catenin signaling" Nature, 545(7653):234-237. HHS Public Access Author Manuscript, 35 pages.

Jin, Y-R. and J.K. Yoon (Dec. 2012) "The R-spondin family of proteins: Emerging regulators of WNT signaling" Int J Biochem Cell Biol, 44(12):2278-2287, doi: 10.1016/j.biocel.2012.09.006.

Keerthivasan, S. et al. (Feb. 2014) "Wnt/Beta-catenin signaling in T-cells drives epigenetic imprinting of pro-inflammatory properties and promotes colitis and colon cancer" Sci Transl Med, 6(225):225ra28, doi: 10.1126/scitranslmed.3007607. NIH Public Access Author Manuscript, 28 pages.

Kim, K.-A. et al. (Jun. 2008) "R-Spondin Family Members Regulate the Wnt Pathway by a Common Mechanism" Mol Biol Cell, 19(6):2588-2596.

Knight, M.N. and K. Hankenson (2014) "R-spondins: Novel matricellular regulators of the skeleton" Matrix Biology, 37:157-161.

Krupnik, V.E. et al. (1999) "Functional and structural diversity of the human Dickkopf gene family" Gene, 238(2):301-313.

Li, L. et al. (Feb. 22, 2002) "Second Cysteine-rich Domain of Dickkopf-2 Activates Canonical Wnt Signaling Pathway via LRP-6 Independently of Dishevelled" J Biol Chem, 277(8):5977-5981.

Lo, M. et al. (Mar. 3, 2017) "Effector-attenuating Substitutions That Maintain Antibody Stability and Reduce Toxicity in Mice" J Biol Chem, 292:3900-3908.

Mannstadt, M. et al. (1999) "Receptors for PTH and PTHrP: their biological importance and functional properties" American Journal of Physiology, 277:F665-F675.

McMahon, A.P. (Jul. 1992) "The Wnt family of developmental regulators" Trends Genet, 8:236-242.

Meier, M. et al. (2000) Crystal Structure of the Carbohydrate Recognition Domain of the H1 Subunit of the Asialoglycoprotein Receptor. J Mol Biol. 300:857-865.

Miller, J.R. (Dec. 28, 2001) "The Wnts" Genome Biol, 3(1):3001.1-3001.15.

Moon, B-I. et al. (2015) "Functional Modulation of Regulatory T Cells by IL-2" PLoS One, 10(11):e0141864, doi:10.1371/journal.pone.0141864; 13 pages.

Ngora, H. et al. (Feb. 2012) "Membrane-Bound and Exosomal Metastasis-Associated C4.4A Promotes Migration by Associating with the α6β4 Integrin and MT1-MMP1,2" Neoplasia, 14(2):95-107.

Pace, L. et al. (2005) "IL-4 Modulation of CD4+ CD25+ T Regulatory Cell-Mediated Suppression" J Immunol, 174(12):7645-7653.

Papkoff, J. et al. (May 1996) "Wnt-1 Regulates Free Pools of Catenins and Stabilizes APC-Catenin Complexes" Mol Cell Biol, 16:2128-2134.

Paret, B. et al. (Jul. 10, 2005) "Ly6 family member C4.4A binds laminins 1 and 5, associates with Galectin-3 and supports cell migration" International Journal of Cancer, 115(5):724-733.

Paul, W.E. (1993) "Fv Structure and Diversity in Three Dimensions" in Fundamental Immunology, 3rd ed. Raven Press, NY; Chap. 9, pp. 292-295.

Perez De La Lastra, J.M. et al. (Apr. 1999) Epitope mapping of 10 monoclonal antibodies against the pig analogue of human membrane cofactor protein (MCP). Immunology, vol. 96, No. 4, pp. 663-670. DOI: 10.1046/j.1365-2567.1999.00732.x.

Rudikoff, S. et al., "Single amino acid substitution altering antigen-binding specificity," Proceedings of the National Academy of Sciences, USA, Mar. 1982, 79(6), pp. 1979-1983.

Russell, J.O. and S. P. Monga. (2018) Wnt/beta-Catenin Signaling in Liver Development, Homeostasis, and Pathobiology. Annu. Rev. Pathol. Mech. Dis, 13:351-378, DOI: 10.1146/annurev-pathol-020117-044010.

Sanhueza, C.A. et al. (2017) "Efficient Liver Targeting by Polyvalent Display of a Compact Ligand for the Asialoglycoprotein Receptor" J Am Chem Soc, 139:3528-3536.

Sato et al. (2011). "Long-term expansion of epithelial organoids from human colon, adenoma, adenocarcinoma, and Barrett's epithelium," Gastroenterology, 141: 1762-1772.

Sato, T. et al. (May 14, 2009) "Single Lgr5 stem cells build crypt-villus structures in vitro without a mesenchymal niche" Nature, 459:262-265, www.nature.com/doifinder/10.1038/nature07935; with "Methods", 1 page.

Scatchard, G. "The Attractions of Proteins for Small Molecules and Ions", Annals of the New York Academy of Sciences, (1949) 51: 660-672.

Shilpi, S. et al. (Jul. 2018) Drug targeting strategies for liver cancer and other liver diseases. MOJ Drug Design Development & Therapy, vol. 2, No. 4, pp. 171-177.

Skolnick J., et al., "From Genes to Protein Structure and Function: Novel Applications of Computational Approaches in the Genomic Era," Trends in Biotechnology, Jan. 2000, vol. 18, pp. 34-39.

Stockert, R.J. et al. (1991) "Structural Characteristics and Regulation of the Asialoglycoprotein Receptor" Targeted Diagnostics and Therapy 4:41-64.

Tao, Guo-Zhong et al. (Jun. 2013) Wnt/[beta]-Catenin Signaling Protects Mouse Liver against Oxidative Stress-induced Apoptosis through the Inhibition of Forkhead Transcription Factor FoxO3 J Biol Chem, 288(24):17214-17224.

Thomason, H.A. et al. (2010) "Desmosomes: adhesive strength and signalling in health and disease" Biochemical Journal, 429(3):419-433.

Uniprotkb, (ASGR1_Human) Asialoglycoprotein receptor I. UniProtKB Accession No. P07306. Last Modified: Feb. 23, 2022. [online]. Retrieved Mar. 24, 2022 from: https://www.dot.uniprot.org/uniprot/P07306; 16 printed pages.

Uniprotkb, Membrane protein. UniProtKB Accession No. A0A0M8ZAH5. Last Modified: Dec. 9, 2015. [online]. [Retrieved on Mar. 8, 2018]. Retrieved from the Internet: URL: http://www.uniprot.org/uniproUAOAOM8ZAH5 Protein, and Sequence (370 a.a.); 3 printed pages.

Witzigmann, D., et al., "Variable Asialoglycoprotein Receptor 1 Expression in Liver Disease: Implications for Therapeutic Intervention," Hepatology Research, Jun. 2016, vol. 46(7), pp. 686-696.

Worthen, C.A. and C.A. Enns (Mar. 6, 2014) "The role of hepatic transferring receptor 2 in the regulation of iron homeostasis in the body" Frontiers in Pharmacology, 5:34, 8 pages.

Xie, Y. et al. (Oct. 2013) "Interaction with both ZNRF3 and LGR4 is required for the signalling activity of R-spondin" EMBO Reports, 14(12):1120-1126.

Yan, H. et al. (Nov. 13, 2012) "Sodium taurocholate cotransporting polypeptide is a functional receptor for human hepatitis B and D virus" eLife, 1:e00049, http://dx.doi.org/10.7554/eLife.00049; 28 pages.

Yan, J-J. et al. (2015) "Active radar guides missile to its target: receptor-based targeted treatment of hepatocellular carcinoma by nanoparticulate systems" Tumor Biology, 36:55-67.

Yang, W.H. et al. (2018) Accelerated Aging and Clearance of Host Anti-inflammatory Enzymes by Discrete Pathogens Fuels Sepsis. Cell Host Microbe. 24(4):500-513.

Yang-Snyder, J. et al. (1996) "A frizzled homolog functions in a vertebrate Wnt signaling pathway" Curr Biol, 6:1302-1306.

(56) References Cited

OTHER PUBLICATIONS

You, J. et al. (2008) "Wnt pathway-related gene expression in inflammatory bowel disease" Dig Dis Sci, 53(4):1013-1019.

Zapata, G. et al. (1995) Engineering linear F(ab')2 fragments for efficient production in *Escherichia coli* and enhanced antiproferative activity. Protein Eng. 8(10): 1057-1062.

Zhang, Z. et al. (Aug. 2020) Tissue-targeted Rspondin mimetics for liver regeneration. Scientific Reports, vol. 10, No. 1, Article 13951; DOI: 10.1038/s41598-020-70912-3, 14 pages.

Chen, Q. "Canonical Wnt signaling in diabetic retinopathy" Vision Research (2017); 139:47-58, Author Manuscript, 26 pages.

Chidiac et al. "A Norrin/Wnt surrogate antibody stimulates endothelial cell barrier function and rescues retinopathy" EMBO Molecular Medicine (2021); 13(7):e13977, 16 pages.

Carmon et al. "R-spondins function as ligands of the orphan receptors LGR4 and LGR5 to regulate Wnt/β-catenin signaling" Proceedings of the National Academy of Sciences (2011); 108(28):11452-11457.

Glinka et al. "LGR4 and LGR5 are R-spondin receptors mediating Wnt/β-catenin and Wnt/PCP signalling" EMBO Reports (2011); 12(10):1055-1061.

Marvin et al. "Redesigning an antibody fragment for faster association with its antigen" Biochemistry (2003); 42(23):7077-7083.

Nusse et al. "Wnt/β-catenin signaling, disease, and emerging therapeutic modalities" Cell (2017); 169(6):985-999.

U.S. Appl. No. 18/896,546, filed Sep. 25, 2024, by Luca et al.

U.S. Appl. No. 19/067,617, filed Feb. 28, 2025, by Vincent Christopher Luca, et al.

\* cited by examiner

```
Rspo1   MRLGLC-VVALVLSWTHLTISSRGIKGKRQRRISAEGSQACAKGCELCSEVNGCLKCSPK   59
Rspo2   MQFRLFSFALIILNCMDYSHCQGNR-WRRSKR-ASYVSNFICKGCLSCSKDNGCSRCQQK   58
Rspo3   MHLRLISWLFIILNFMEYIGSQNASRGRRQRRMHPNVSQGCQGGCATCSDYNGCLSCKFR   60
Rspo4   MRAPLCLLLL-VAHAVDMLA--------LNRRKKQVGTGLGGNCTGCIICSEENGCSTCQQR   53
        *:  *       :     .      .* ::          **  **. ***  *  :

Rspo1   LFILLERNDIRQVGVCLPSCPPGYFDARNPDMNKCIK                         119
Rspo2   LFFFLRREGMRQYGECLHSCPSGYYGHRAPDMNRCAR                         118
Rspo3   LFFALERIGMKQIGVCLSSCPSGYYGTRYPDINKCTK                         119
Rspo4   LFLFIRREGIRQYGKCLHDCPGYFGIRGQEVNRCKK                          112
        **: .* *:  ::* * **.** * *   * :*:*  :

Rspo1                                        PAQCEMSEWSPWGPCSKKQQLCGFRRGSEERTRRV   179
Rspo2                                        --GCEVGHWSEWGTCSRNNRTCGFKWGLETRTRQI   176
Rspo3                                        IVHCEVSEWNPWSPCTKKGKTCGFKRGTETRVREI   179
Rspo4                                        --ECELGPWGGWSPCTHNGKTCGSAWGLESRVREA   170
                                               **:. *. *. *::: : **   * * *.*.

Rspo1   LHAPVGDHAACSDTKETRRCTVRRVPCPEGQKR---RKGGQGRRENANRNLARKESKE---   234
Rspo2   VKKPVKDTILCPTIAESRRCKMTMRHCPGGKRT---PKAKEKRNKKKKRKLIERAQEQHSV   234
Rspo3   IQHPSAKGNLCPPTNETRKCTVQRKKCQKGERG---KKGRERKRKKPNKGESKEAIPDSKS   237
Rspo4   GRAGHEEAATCQVLSESRKCPIQR-PCPGERSPGQKKGRKDRRPRKDRKLDRRLDVR---   226
           :     . *   *:*;*  :    *     *. *: . .:   ..

Rspo1   ---AGAGS-RRRKGQQQQQ--------QQGTVPLTSAGPA   263 (SEQ ID NO:1)
Rspo2   FLA------TDRANQ--------------------------   243 (SEQ ID NO:2)
Rspo3   LESSKEIPEQRENKQQQKKRKVQDKQKSVSVSTVH----   272 (SEQ ID NO:3)
Rspo4   ----------PRQPGLQP---------------------   234 (SEQ ID NO:4)
              : .
```

FIG. 4E
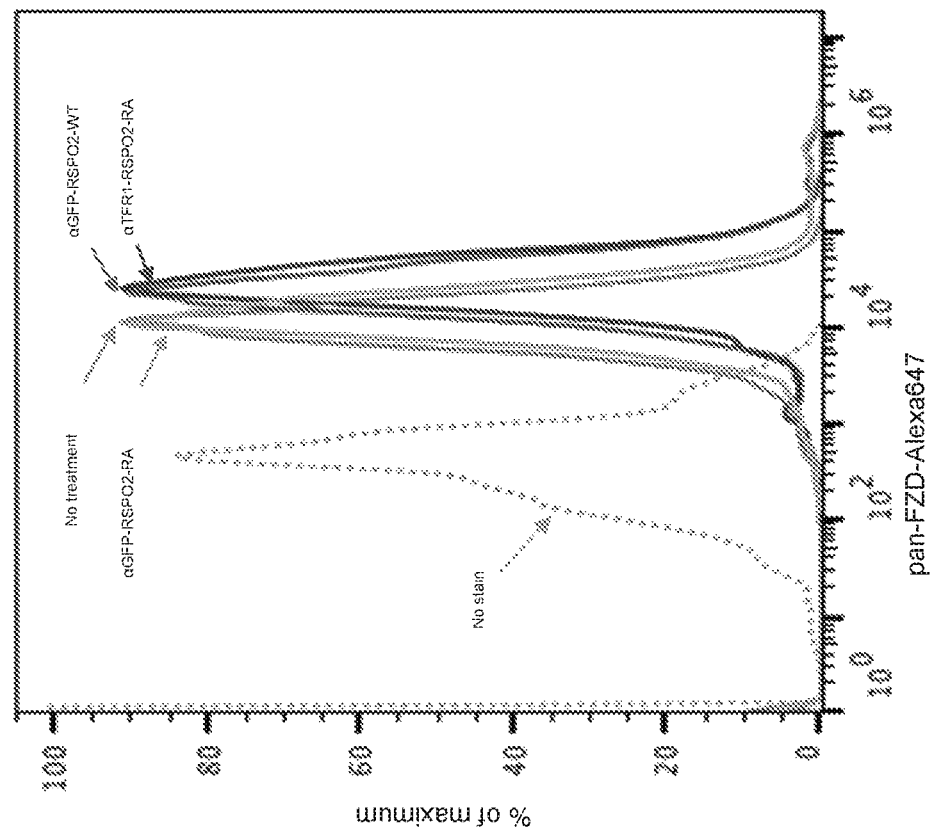
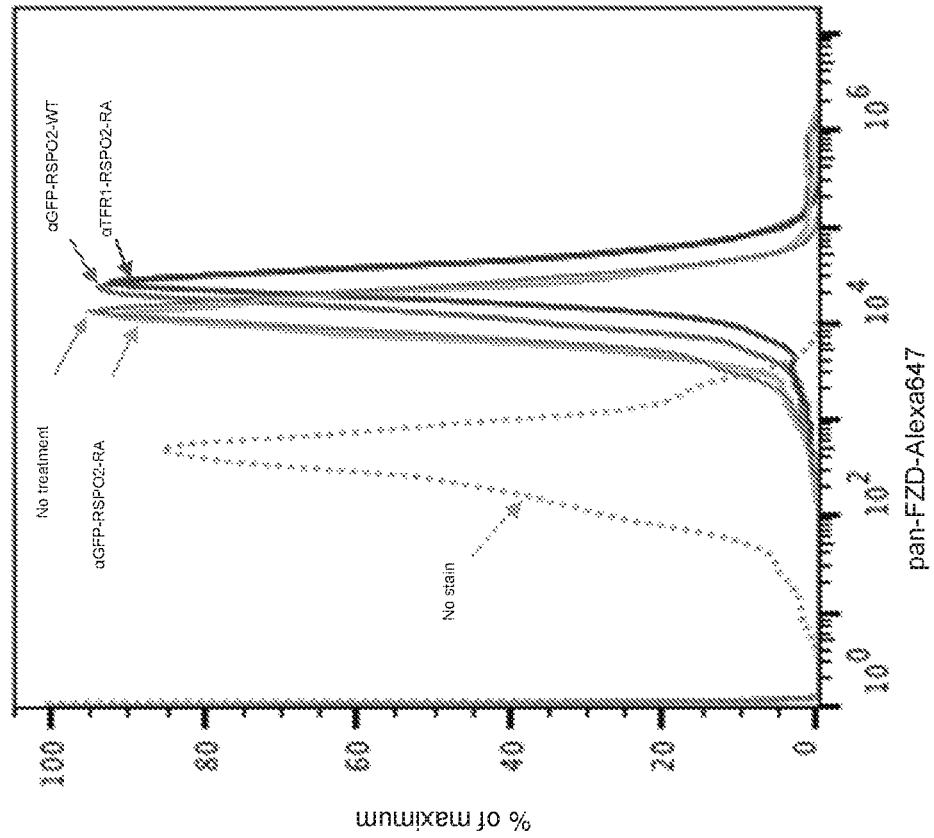

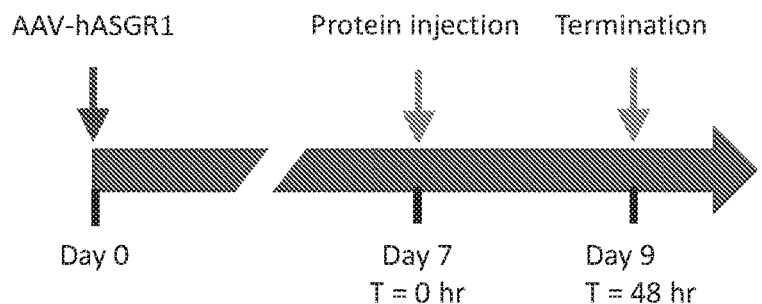
FIG. 6A
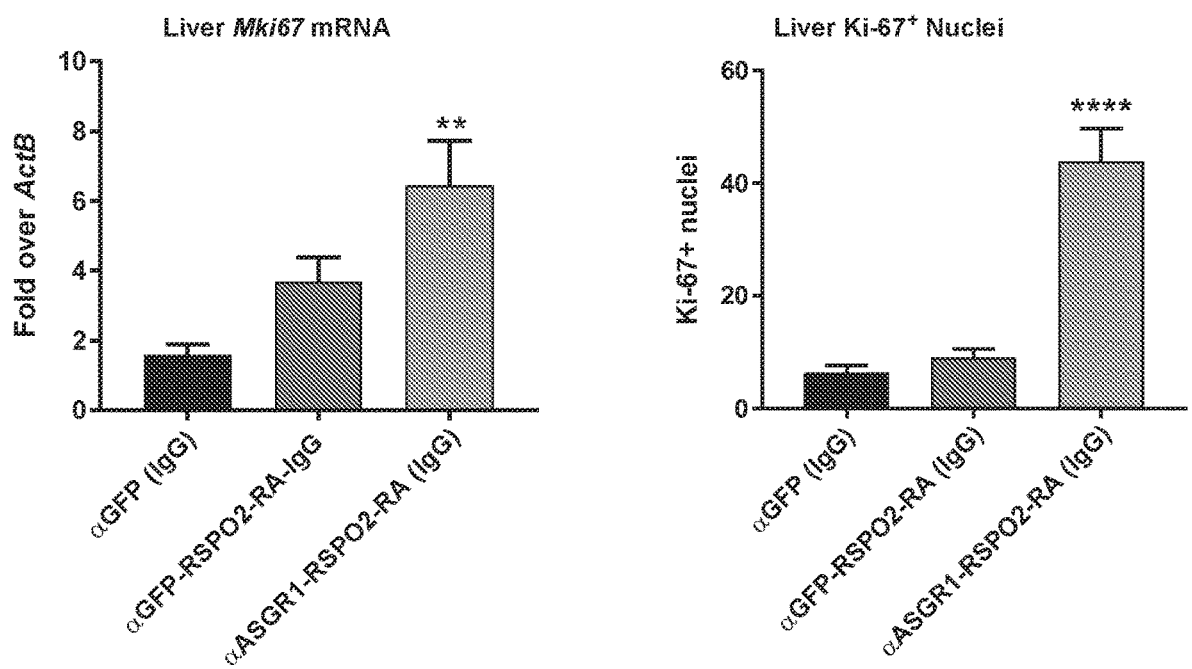
FIG. 6B                    FIG. 6C

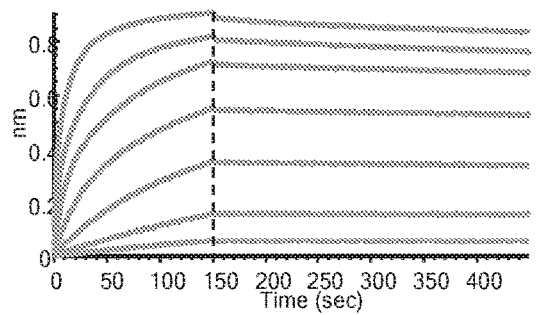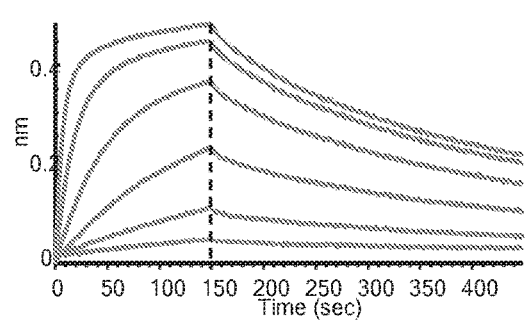
FIG. 7C

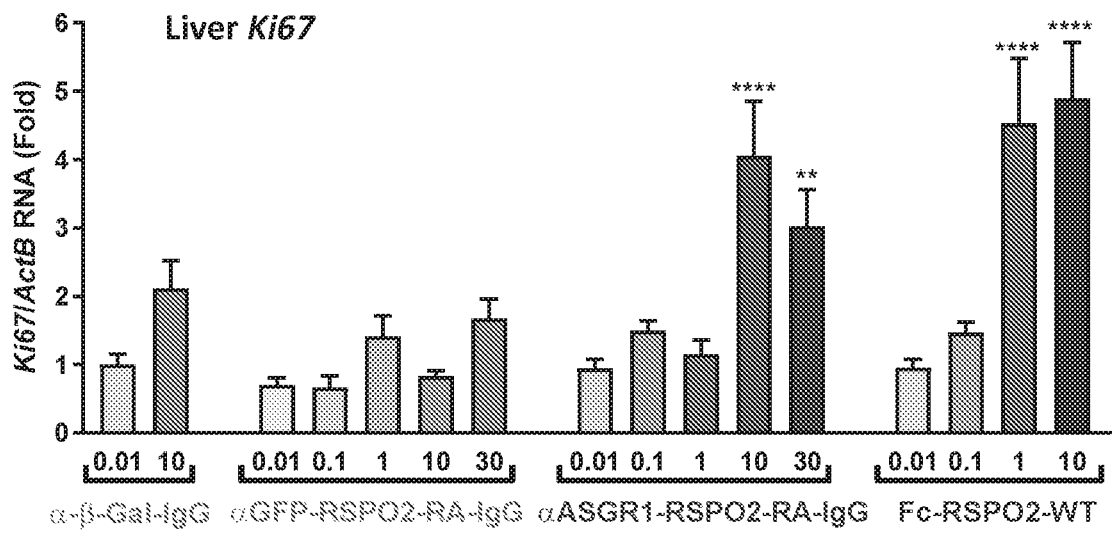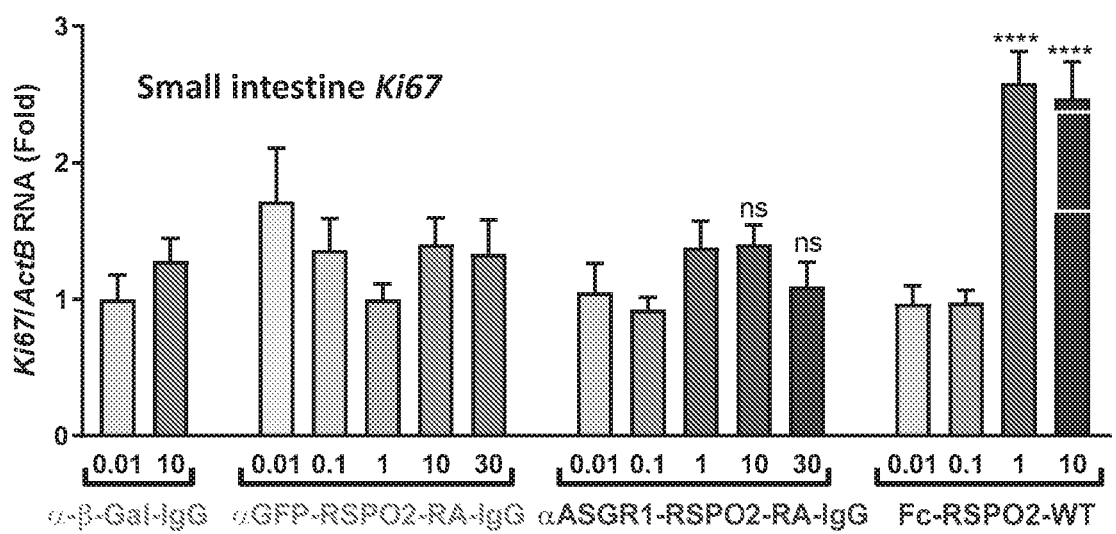
FIG. 9C

WNT SIGNAL ENHANCER SEQUENCES

Anti-GFP, RSPO2 wild type – polynucleotide (SEQ ID NO: 5)

CAGGTCCAGTTGGTGGAATCCGGAGGGGGTTTGGTCCAGCCTGGTGGAAGCCTG
CGCCTCTCATGCGCCGCTAGCGGATTCACCTTCTCCCGATACGGCATGCATTGGG
TCAGACAGGCACCCGGAAAAGGACTCGAATGGGTGTCGGGCATTTCCTCGATCG
GGTCAAACACCTATTACGCCGACTCCGTGAAGGGACGGTTCACCATTAGCCGGG
ATAACAGCAAGAACACTCTGTACTTGCAAATGAACTCCCTGCGGGCTGAGGACA
CCGCCGTGTACTACTGTGCGCGGTGGTACAAGACCTATATTGACGTCTGGGGACA
GGGTACCCTCGTGACCGTGTCATCCGGTGGTGGAGGATCCGGAGGCGGAGGAAG
CGGAGGAGGGGGTTCAGACATCGAACTCACCCAGCCCCCGTCAGTGTCCGTGGC
CCCTGGACAGACTGCGCGCATCTCCTGCTCCGGCGACAACCTGGGGAAGAAATA
CGTGTACTGGTACCAGCAGAAGCCAGGTCAAGCCCCTGTGCTGGTCATCTACGGC
GACGACGAAAGGCCGTCAGGCATCCCAGAGCGCTTCTCCGGCTCCAACTCCGGG
AATACTGCCACCCTTACCATTTCCGGAACCCAGGCCGAGGATGAAGCGGATTACT
ATTGCGCGAGCTACGATAGCAGCCACATCCTGATCGTGTTTGGAGGCGGTACTAA
GCTGACCGTGCTGGGAAGCGGTGGATCAAACCCAATTTGCAAGGGATGCCTGAG
CTGTAGCAAGGACAACGGATGTTCACGGTGCCAGCAAAAGCTGTTTTTCTTCCTC
CGGCGGGAAGGAATGCGGCAGTACGGCGAATGTCTCCACTCCTGCCCCTCGGGG
TATTACGGACACCGCGCGCCTGACATGAACCGATGCGCCAGATGCCGGATCGAG
AACTGCGATAGCTGCTTCAGCAAGGACTTCTGCACTAAGTGCAAAGTCGGCTTCT
ACCTTCACCGGGGCAGATGTTTTGACGAATGCCCGGATGGCTTCGCCCCGCTGGA
GGAGACTATGGAATGCGTGGAGGGCGGAGACTACAAGGACGACGATGACAAGG
GCTCCCACCATCACCACCATCATCACCACTAG

Anti-GFP, RSPO2 wild type – polypeptide (SEQ ID NO: 6)

QVQLVESGGGLVQPGGSLRLSCAASGFTFSRYGMHWVRQAPGKGLEWVSGISSIGS
NTYYADSVKGRFTISRDNSKNTLYLQMNSLRAEDTAVYYCARWYKTYIDVWGQGT
LVTVSSGGGGSGGGGSGGGGSDIELTQPPSVSVAPGQTARISCSGDNLGKKYVYWY
QQKPGQAPVLVIYGDDERPSGIPERFSGSNSGNTATLTISGTQAEDEADYYCASYDSS
HILIVFGGGTKLTVLGSGGSNPICKGCLSCSKDNGCSRCQQKLFFFLRREGMRQYGEC
LHSCPSGYYGHRAPDMNRCARCRIENCDSCFSKDFCTKCKVGFYLHRGRCFDECPD
GFAPLEETMECVEGGDYKDDDDKGSHHHHHHHH

FIGURE 11A

Anti-GFP, RSPO2 (F105R/F109A) – polynucleotide (SEQ ID NO: 7)

CAGGTCCAGTTGGTGGAATCCGGAGGGGGTTTGGTCCAGCCTGGTGGAAGCCTG
CGCCTCTCATGCGCCGCTAGCGGATTCACCTTCTCCCGATACGGCATGCATTGGG
TCAGACAGGCACCCGGAAAAGGACTCGAATGGGTGTCGGGCATTTCCTCGATCG
GGTCAAACACCTATTACGCCGACTCCGTGAAGGGACGGTTCACCATTAGCCGGG
ATAACAGCAAGAACACTCTGTACTTGCAAATGAACTCCCTGCGGGCTGAGGACA
CCGCCGTGTACTACTGTGCGCGGTGGTACAAGACCTATATTGACGTCTGGGGACA
GGGTACCCTCGTGACCGTGTCATCCGGTGGTGGAGGATCCGGAGGCGGAGGAAG
CGGAGGAGGGGGTTCAGACATCGAACTCACCCAGCCCCCGTCAGTGTCCGTGGC
CCCTGGACAGACTGCGCGCATCTCCTGCTCCGGCGACAACCTGGGGAAGAAATA
CGTGTACTGGTACCAGCAGAAGCCAGGTCAAGCCCCTGTGCTGGTCATCTACGGC
GACGACGAAAGGCCGTCAGGCATCCCAGAGCGCTTCTCCGGCTCCAACTCCGGG
AATACTGCCACCCTTACCATTTCCGGAACCCAGGCCGAGGATGAAGCGGATTACT
ATTGCGCGAGCTACGATAGCAGCCACATCCTGATCGTGTTTGGAGGCGGTACTAA
GCTGACCGTGCTGGGAAGCGGTGGATCAAACCCAATTTGCAAGGGATGCCTGAG
CTGTAGCAAGGACAACGGATGTTCACGGTGCCAGCAAAAGCTGTTTTCTTCCTC
CGGCGGGAAGGAATGCGGCAGTACGGCGAATGTCTCCACTCCTGCCCCTCGGGG
TATTACGGACACCGCGCGCCTGACATGAACCGATGCGCCAGATGCCGGATCGAG
AACTGCGATAGCTGCCGCAGCAAGGACGCCTGCACTAAGTGCAAAGTCGGCTTC
TACCTTCACCGGGGCAGATGTTTTGACGAATGCCCGGATGGCTTCGCCCCGCTGG
AGGAGACTATGGAATGCGTGGAGGGCGGAGACTACAAGGACGACGATGACAAG
GGCTCCCACCATCACCACCATCATCACCACTAG

Anti-GFP, RSPO2 (F105R/F109A) – polypeptide (SEQ ID NO: 8)

QVQLVESGGGLVQPGGSLRLSCAASGFTFSRYGMHWVRQAPGKGLEWVSGISSIGS
NTYYADSVKGRFTISRDNSKNTLYLQMNSLRAEDTAVYYCARWYKTYIDVWGQGT
LVTVSSGGGGSGGGGSGGGGSDIELTQPPSVSVAPGQTARISCSGDNLGKKYVYWY
QQKPGQAPVLVIYGDDERPSGIPERFSGSNSGNTATLTISGTQAEDEADYYCASYDSS
HILIVFGGGTKLTVLGSGGSNPICKGCLSCSKDNGCSRCQQKLFFFLRREGMRQYGEC
LHSCPSGYYGHRAPDMNRCARCRIENCDSCRSKDACTKCKVGFYLHRGRCFDECPD
GFAPLEETMECVEGGDYKDDDDKGSHHHHHHHH

Anti-GFP, RSPO2 (R65A/R69A/Q70A/F105A/F109A) – polynucleotide (SEQ ID NO: 9)

CAGGTCCAGTTGGTGGAATCCGGAGGGGGTTTGGTCCAGCCTGGTGGAAGCCTG
CGCCTCTCATGCGCCGCTAGCGGATTCACCTTCTCCCGATACGGCATGCATTGGG
TCAGACAGGCACCCGGAAAAGGACTCGAATGGGTGTCGGGCATTTCCTCGATCG
GGTCAAACACCTATTACGCCGACTCCGTGAAGGGACGGTTCACCATTAGCCGGG
ATAACAGCAAGAACACTCTGTACTTGCAAATGAACTCCCTGCGGGCTGAGGACA
CCGCCGTGTACTACTGTGCGCGGTGGTACAAGACCTATATTGACGTCTGGGGACA
GGGTACCCTCGTGACCGTGTCATCCGGTGGTGGAGGATCCGGAGGCGGAGGAAG
CGGAGGAGGGGGTTCAGACATCGAACTCACCCAGCCCCCGTCAGTGTCCGTGGC
CCCTGGACAGACTGCGCGCATCTCCTGCTCCGGCGACAACCTGGGGAAGAAATA
CGTGTACTGGTACCAGCAGAAGCCAGGTCAAGCCCCTGTGCTGGTCATCTACGGC
GACGACGAAAGGCCGTCAGGCATCCAGAGCGCTTCTCCGGCTCCAACTCCGGG
AATACTGCCACCCTTACCATTTCCGGAACCCAGGCCGAGGATGAAGCGGATTACT
ATTGCGCGAGCTACGATAGCAGCCACATCCTGATCGTGTTTGGAGGCGGTACTAA
GCTGACCGTGCTGGGAAGCGGTGGATCAAACCCAATTTGCAAGGGATGCCTGAG
CTGTAGCAAGGACAACGGATGTTCACGGTGCCAGCAAAAGCTGTTTTTCTTCCTC
CGGGCCGAAGGAATGGCCGCATACGGCGAATGTCTCCACTCCTGCCCCTCGGGG
TATTACGGACACCGCGCCTGACATGAACCGATGCGCCAGATGCCGGATCGAG
AACTGCGATAGCTGCCGCAGCAAGGACGCCTGCACTAAGTGCAAAGTCGGCTTC
TACCTTCACCGGGGCAGATGTTTTGACGAATGCCCGGATGGCTTCGCCCCGCTGG
AGGAGACTATGGAATGCGTGGAGGGCGGAGACTACAAGGACGACGATGACAAG
GGCTCCCACCATCACCACCATCATCACCACTAG

Anti-GFP, RSPO2 (R65A/R69A/Q70A/F105A/F109A) – polypeptide (SEQ ID NO: 10)

QVQLVESGGGLVQPGGSLRLSCAASGFTFSRYGMHWVRQAPGKGLEWVSGISSIGS
NTYYADSVKGRFTISRDNSKNTLYLQMNSLRAEDTAVYYCARWYKTYIDVWGQGT
LVTVSSGGGGSGGGGSGGGGSDIELTQPPSVSVAPGQTARISCSGDNLGKKYVYWY
QQKPGQAPVLVIYGDDERPSGIPERFSGSNSGNTATLTISGTQAEDEADYYCASYDSS
HILIVFGGGTKLTVLGSGGSNPICKGCLSCSKDNGCSRCQQKLFFFLRAEGMAAYGE
CLHSCPSGYYGHRAPDMNRCARCRIENCDSCRSKDACTKCKVGFYLHRGRCFDECP
DGFAPLEETMECVEGGDYKDDDDKGSHHHHHHHH

FIGURE 11C

Anti-ASGR1, RSPO2 wild type – polynucleotide (SEQ ID NO: 11)

GAAGTGCAGCTGCTGGAATCCGGGGGCGGACTGGTGCAACCCGGGGGATCCCTC
AGACTGTCCTGTGCCGCATCGGGTTTCACTTTCTCCTCCTACGCGATGTCATGGGT
CAGACAGGCCCCTGGAAAAGGCCTCGAATGGGTGTCGGCTATCTCCGGATCGGG
GGGATCTACTTACTACGCCGACTCCGTGAAGGGCCGGTTCACTATCTCGAGGGAC
AACTCCAAGAATACCCTGTACTTGCAAATGAACTCCCTGCGCGCCGAGGATACC
GCGGTGTATTACTGCGCCAAGGACTTCAGCTCACGCCGGTGGTACCTTGAGTACT
GGGGACAGGGAACCCTTGTCACCGTGTCCAGCGGTGGCGGCGGAAGCGGCGGGG
GCGGATCCGGTGGCGGGGGCTCAGAGCTCACCCAGGACCCCGCTGTGTCCGTGG
CCTTGGGACAGACCGTGCGCATCACATGCCAGGGCGATAGCCTGCGGAGCTATT
ACGCCTCGTGGTACCAGCAGAAGCCTGGTCAAGCGCCGGTCCTGGTCATCTACG
GAAAGAACAACCGCCCGTCCGGAATTCCAGACAGGTTCAGCGGATCCAGCTCGG
GGAACACCGCCTCACTGACTATCACCGGAGCACAGGCCGAAGATGAAGCCGACT
ACTACTGCAACTCCCTGGAGCGGATTGGATACCTGAGCTACGTGTTTGGTGGCGG
CACGAAGCTCACCGTGCTGGGAAGCGGTGGATCAAACCCAATTTGCAAGGGATG
CCTGAGCTGTAGCAAGGACAACGGATGTTCACGGTGCCAGCAAAAGCTGTTTTC
TTCCTCCGGCGGGAAGGAATGCGGCAGTACGGCGAATGTCTCCACTCCTGCCCCT
CGGGGTATTACGGACACCGCGCGCCTGACATGAACCGATGCGCCAGATGCCGGA
TCGAGAACTGCGATAGCTGCTTCAGCAAGGACTTCTGCACTAAGTGCAAAGTCG
GCTTCTACCTTCACCGGGGCAGATGTTTGACGAATGCCCGGATGGCTTCGCCCC
GCTGGAGGAGACTATGGAATGCGTGGAGGGCGGAGACTACAAGGACGACGATG
ACAAGGGCTCCCACCATCACCACCATCATCACCACTAG

Anti-ASGR1, RSPO2 wild type – polypeptide (SEQ ID NO: 12)

EVQLLESGGGLVQPGGSLRLSCAASGFTFSSYAMSWVRQAPGKGLEWVSAISGSGG
STYYADSVKGRFTISRDNSKNTLYLQMNSLRAEDTAVYYCAKDFSSRRWYLEYWG
QGTLVTVSSGGGGSGGGGSGGGGSELTQDPAVSVALGQTVRITCQGDSLRSYYASW
YQQKPGQAPVLVIYGKNNRPSGIPDRFSGSSSGNTASLTITGAQAEDEADYYCNSLER
IGYLSYVFGGGTKLTVLGSGGSNPICKGCLSCSKDNGCSRCQQKLFFFLRREGMRQY
GECLHSCPSGYYGHRAPDMNRCARCRIENCDSCFSKDFCTKCKVGFYLHRGRCFDE
CPDGFAPLEETMECVEGGDYKDDDDKGSHHHHHHHH

FIGURE 11D

Anti-ASGR1, RSPO2 (F105R/F109A) – polynucleotide (SEQ ID NO: 13)

GAAGTGCAGCTGCTGGAATCCGGGGGCGGACTGGTGCAACCCGGGGGATCCCTC
AGACTGTCCTGTGCCGCATCGGGTTTCACTTTCTCCTCCTACGCGATGTCATGGGT
CAGACAGGCCCCTGGAAAAGGCCTCGAATGGGTGTCGGCTATCTCCGGATCGGG
GGGATCTACTTACTACGCCGACTCCGTGAAGGGCCGGTTCACTATCTCGAGGGAC
AACTCCAAGAATACCCTGTACTTGCAAATGAACTCCCTGCGCGCCGAGGATACC
GCGGTGTATTACTGCGCCAAGGACTTCAGCTCACGCCGGTGGTACCTTGAGTACT
GGGGACAGGGAACCCTTGTCACCGTGTCCAGCGGTGGCGGCGGAAGCGGCGGGG
GCGGATCCGGTGGCGGGGGCTCAGAGCTCACCCAGGACCCCGCTGTGTCCGTGG
CCTTGGGACAGACCGTGCGCATCACATGCCAGGGCGATAGCCTGCGGAGCTATT
ACGCCTCGTGGTACCAGCAGAAGCCTGGTCAAGCGCCGGTCCTGGTCATCTACG
GAAAGAACAACCGCCCGTCCGGAATTCCAGACAGGTTCAGCGGATCCAGCTCGG
GGAACACCGCCTCACTGACTATCACCGGAGCACAGGCCGAAGATGAAGCCGACT
ACTACTGCAACTCCCTGGAGCGGATTGGATACCTGAGCTACGTGTTTGGTGGCGG
CACGAAGCTCACCGTGCTGGGAAGCGGTGGATCAAACCCAATTTGCAAGGGATG
CCTGAGCTGTAGCAAGGACAACGGATGTTCACGGTGCCAGCAAAAGCTGTTTTTC
TTCCTCCGGCGGGAAGGAATGCGGCAGTACGGCGAATGTCTCCACTCCTGCCCCT
CGGGGTATTACGGACACCGCGCGCCTGACATGAACCGATGCGCCAGATGCCGGA
TCGAGAACTGCGATAGCTGCCGCAGCAAGGACGCCTGCACTAAGTGCAAAGTCG
GCTTCTACCTTCACCGGGGCAGATGTTTTGACGAATGCCCGGATGGCTTCGCCCC
GCTGGAGGAGACTATGGAATGCGTGGAGGGCGGAGACTACAAGGACGACGATG
ACAAGGGCTCCCACCATCACCACCATCATCACCACTAG

Anti-ASGR1, RSPO2 (F105R/F109A) – polypeptide (SEQ ID NO: 14)

EVQLLESGGGLVQPGGSLRLSCAASGFTFSSYAMSWVRQAPGKGLEWVSAISGSGG
STYYADSVKGRFTISRDNSKNTLYLQMNSLRAEDTAVYYCAKDFSSRRWYLEYWG
QGTLVTVSSGGGGSGGGGSGGGGSELTQDPAVSVALGQTVRITCQGDSLRSYYASW
YQQKPGQAPVLVIYGKNNRPSGIPDRFSGSSSGNTASLTITGAQAEDEADYYCNSLER
IGYLSYVFGGGTKLTVLGSGGSNPICKGCLSCSKDNGCSRCQQKLFFFLRREGMRQY
GECLHSCPSGYYGHRAPDMNRCARCRIENCDSCRSKDACTKCKVGFYLHRGRCFDE
CPDGFAPLEETMECVEGGDYKDDDDKGSHHHHHHHH

FIGURE 11E

Anti-ASGR1, RSPO2 (R65A/R69A/Q70A/F105A/F109A) – polynucleotide (SEQ ID NO: 15)

GAAGTGCAGCTGCTGGAATCCGGGGGCGGACTGGTGCAACCCGGGGGATCCCTC
AGACTGTCCTGTGCCGCATCGGGTTTCACTTTCTCCTCCTACGCGATGTCATGGGT
CAGACAGGCCCCTGGAAAAGGCCTCGAATGGGTGTCGGCTATCTCCGGATCGGG
GGGATCTACTTACTACGCCGACTCCGTGAAGGGCCGGTTCACTATCTCGAGGGAC
AACTCCAAGAATACCCTGTACTTGCAAATGAACTCCCTGCGCGCCGAGGATACC
GCGGTGTATTACTGCGCCAAGGACTTCAGCTCACGCCGGTGGTACCTTGAGTACT
GGGGACAGGGAACCCTTGTCACCGTGTCCAGCGGTGGCGGCGGAAGCGGCGGGG
GCGGATCCGGTGGCGGGGGCTCAGAGCTCACCCAGGACCCCGCTGTGTCCGTGG
CCTTGGGACAGACCGTGCGCATCACATGCCAGGGCGATAGCCTGCGGAGCTATT
ACGCCTCGTGGTACCAGCAGAAGCCTGGTCAAGCGCCGGTCCTGGTCATCTACG
GAAAGAACAACCGCCCGTCCGGAATTCCAGACAGGTTCAGCGGATCCAGCTCGG
GGAACACCGCCTCACTGACTATCACCGGAGCACAGGCCGAAGATGAAGCCGACT
ACTACTGCAACTCCCTGGAGCGGATTGGATACCTGAGCTACGTGTTTGGTGGCGG
CACGAAGCTCACCGTGCTGGGAAGCGGTGGATCAAACCCAATTTGCAAGGGATG
CCTGAGCTGTAGCAAGGACAACGGATGTTCACGGTGCCAGCAAAAGCTGTTTTTC
TTCCTCCGGGCCGAAGGAATGGCCGCATACGGCGAATGTCTCCACTCCTGCCCCT
CGGGGTATTACGGACACCGCGCGCCTGACATGAACCGATGCGCCAGATGCCGGA
TCGAGAACTGCGATAGCTGCCGCAGCAAGGACGCCTGCACTAAGTGCAAAGTCG
GCTTCTACCTTCACCGGGGCAGATGTTTGACGAATGCCCGGATGGCTTCGCCCC
GCTGGAGGAGACTATGGAATGCGTGGAGGGCGGAGACTACAAGGACGACGATG
ACAAGGGCTCCCACCATCACCACCATCATCACCACTAG

Anti-ASGR1, RSPO2 (R65A/R69A/Q70A/F105A/F109A) – polypeptide (SEQ ID NO: 16)

EVQLLESGGGLVQPGGSLRLSCAASGFTFSSYAMSWVRQAPGKGLEWVSAISGSGG
STYYADSVKGRFTISRDNSKNTLYLQMNSLRAEDTAVYYCAKDFSSRRWYLEYWG
QGTLVTVSSGGGGSGGGGSGGGGSELTQDPAVSVALGQTVRITCQGDSLRSYYASW
YQQKPGQAPVLVIYGKNNRPSGIPDRFSGSSSGNTASLTITGAQAEDEADYYCNSLER
IGYLSYVFGGGTKLTVLGSGGSNPICKGCLSCSKDNGCSRCQQKLFFFLRAEGMAAY
GECLHSCPSGYYGHRAPDMNRCARCRIENCDSCRSKDACTKCKVGFYLHRGRCFDE
CPDGFAPLEETMECVEGGDYKDDDDKGSHHHHHHHH

FIGURE 11F

Anti-TFR1, RSPO2 wild type – polynucleotide (SEQ ID NO: 17)

CAAGTGCAACTCCAACAAAGCGGTCCCGAGTTGGTCCGACCCGGCGTCAGTGTG
AAAATCTCATGCAAGGGGTCCGGGTATACCTTCACTGACTATGCAATGCACTGGG
TAAAGCAGAGCCACGCCAAGTCCTTGGAGTGGATCGGAGGCATTAGTACCTACT
TCGGACGCACCAACTACAATCAAAAATTTAAGGGTCGCGCAACCATGACTGTAG
ATAAATCATCAAGTACCGCGTACATGGAATTGGCTAGACTGACTTCTGAAGATTC
CGCGCTGTATTACTGTGCTCGCGGTTTGTCTGGCAACTATGTTATGGATTACTGGG
GGCAAGGGACCAGCGTCACGGTGTCCTCTGGCGGAGGCGGGTCCGGGGGGGGTG
GTTCTGGCGGAGGCGGATCCGATATAGTTCTGTTTCAATCCCCTGCGAGCCTGGC
GGTAAGTTTGGGACAGAGAGCCACGATTTCCTGCCGAGCGAGTGAAAGCGTAGA
CGACTACGGCAATTCTTTCATGCACTGGTATCAACAGAAGCCAGGCCAACCGCC
GAAGCTGCTTATCTATCGCGCGTCCAATTTGGAGTCAGGGATCCCTGCACGATTT
TCAGGTTCTGGAAGTAGGACAGACTTTACACTTACGATAAACCCCGTGGAAGCG
GATGACGTCGCAACCTACTATTGTCAACAAAGCAATGAAGCACCACCTACCTTCG
GAGGTGGCACTAAATTGGAAATTAGGGGAAGCGGTGGATCAAACCCAATTTGCA
AGGGATGCCTGAGCTGTAGCAAGGACAACGGATGTTCACGGTGCCAGCAAAAGC
TGTTTTCTTCCTCCGGCGGGAAGGAATGCGGCAGTACGGCGAATGTCTCCACTC
CTGCCCTCGGGGTATTACGGACACCGCGCCTGACATGAACCGATGCGCCAG
ATGCCGGATCGAGAACTGCGATAGCTGCTTCAGCAAGGACTTCTGCACTAAGTG
CAAAGTCGGCTTCTACCTTCACCGGGGCAGATGTTTTGACGAATGCCCGGATGGC
TTCGCCCCGCTGGAGGAGACTATGGAATGCGTGGAGGGCGGAGACTACAAGGAC
GACGATGACAAGGGCTCCCACCATCACCACCATCATCACCACTAG

Anti-TFR1, RSPO2 wild type – polypeptide (SEQ ID NO: 18)

QVQLQQSGPELVRPGVSVKISCKGSGYTFTDYAMHWVKQSHAKSLEWIGGISTYFG
RTNYNQKFKGRATMTVDKSSSTAYMELARLTSEDSALYYCARGLSGNYVMDYWG
QGTSVTVSSGGGGSGGGGSGGGGSDIVLFQSPASLAVSLGQRATISCRASESVDDYG
NSFMHWYQQKPGQPPKLLIYRASNLESGIPARFSGSGSRTDFTLTINPVEADDVATYY
CQQSNEAPPTFGGGTKLEIRGSGGSNPICKGCLSCSKDNGCSRCQQKLFFFLRREGMR
QYGECLHSCPSGYYGHRAPDMNRCARCRIENCDSCFSKDFCTKCKVGFYLHRGRCF
DECPDGFAPLEETMECVEGGDYKDDDDKGSHHHHHHHH

FIGURE 11G

Anti-TFR1, RSPO2 (F105R/F109A) – polynucleotide (SEQ ID NO: 19)

CAAGTGCAACTCCAACAAAGCGGTCCCGAGTTGGTCCGACCCGGCGTCAGTGTG
AAAATCTCATGCAAGGGGTCCGGGTATACCTTCACTGACTATGCAATGCACTGGG
TAAAGCAGAGCCACGCCAAGTCCTTGGAGTGGATCGGAGGCATTAGTACCTACT
TCGGACGCACCAACTACAATCAAAAATTTAAGGGTCGCGCAACCATGACTGTAG
ATAAATCATCAAGTACCGCGTACATGGAATTGGCTAGACTGACTTCTGAAGATTC
CGCGCTGTATTACTGTGCTCGCGGTTTGTCTGGCAACTATGTTATGGATTACTGGG
GGCAAGGGACCAGCGTCACGGTGTCCTCTGGCGGAGGCGGGTCCGGGGGGGTG
GTTCTGGCGGAGGCGGATCCGATATAGTTCTGTTTCAATCCCCTGCGAGCCTGGC
GGTAAGTTTGGGACAGAGAGCCACGATTTCCTGCCGAGCGAGTGAAAGCGTAGA
CGACTACGGCAATTCTTTCATGCACTGGTATCAACAGAAGCCAGGCCAACCGCC
GAAGCTGCTTATCTATCGCGCGTCCAATTTGGAGTCAGGGATCCCTGCACGATTT
TCAGGTTCTGGAAGTAGGACAGACTTTACACTTACGATAAACCCCGTGGAAGCG
GATGACGTCGCAACCTACTATTGTCAACAAAGCAATGAAGCACCACCTACCTTCG
GAGGTGGCACTAAATTGGAAATTAGGGGAAGCGGTGGATCAAACCCAATTTGCA
AGGGATGCCTGAGCTGTAGCAAGGACAACGGATGTTCACGGTGCCAGCAAAAGC
TGTTTTTCTTCCTCCGGCGGGAAGGAATGCGGCAGTACGGCGAATGTCTCCACTC
CTGCCCCTCGGGGTATTACGGACACCGCGCCTGACATGAACCGATGCGCCAG
ATGCCGGATCGAGAACTGCGATAGCTGCCGCAGCAAGGACGCCTGCACTAAGTG
CAAAGTCGGCTTCTACCTTCACCGGGGCAGATGTTTTGACGAATGCCCGGATGGC
TTCGCCCCGCTGGAGGAGACTATGGAATGCGTGGAGGGCGGAGACTACAAGGAC
GACGATGACAAGGGCTCCCACCATCACCACCATCATCACCACTAG

Anti-TFR1, RSPO2 (F105R/F109A) – polypeptide (SEQ ID NO: 20)

QVQLQQSGPELVRPGVSVKISCKGSGYTFTDYAMHWVKQSHAKSLEWIGGISTYFG
RTNYNQKFKGRATMTVDKSSSTAYMELARLTSEDSALYYCARGLSGNYVMDYWG
QGTSVTVSSGGGGSGGGGSGGGGSDIVLFQSPASLAVSLGQRATISCRASESVDDYG
NSFMHWYQQKPGQPPKLLIYRASNLESGIPARFSGSGSRTDFTLTINPVEADDVATYY
CQQSNEAPPTFGGGTKLEIRGSGGSNPICKGCLSCSKDNGCSRCQQKLFFFLRREGMR
QYGECLHSCPSGYYGHRAPDMNRCARCRIENCDSCRSKDACTKCKVGFYLHRGRCF
DECPDGFAPLEETMECVEGGDYKDDDDKGSHHHHHHHH

Anti-TFR1, RSPO2 (R65A/R69A/Q70A/F105A/F109A) – polynucleotide (SEQ ID NO: 21)

CAAGTGCAACTCCAACAAAGCGGTCCCGAGTTGGTCCGACCCGGCGTCAGTGTG
AAAATCTCATGCAAGGGGTCCGGGTATACCTTCACTGACTATGCAATGCACTGGG
TAAAGCAGAGCCACGCCAAGTCCTTGGAGTGGATCGGAGGCATTAGTACCTACT
TCGGACGCACCAACTACAATCAAAAATTTAAGGGTCGCGCAACCATGACTGTAG
ATAAATCATCAAGTACCGCGTACATGGAATTGGCTAGACTGACTTCTGAAGATTC
CGCGCTGTATTACTGTGCTCGCGGTTTGTCTGGCAACTATGTTATGGATTACTGGG
GGCAAGGGACCAGCGTCACGGTGTCCTCTGGCGGAGGCGGGTCCGGGGGGGGTG
GTTCTGGCGGAGGCGGATCCGATATAGTTCTGTTTCAATCCCCTGCGAGCCTGGC
GGTAAGTTTGGGACAGAGAGCCACGATTCCTGCCGAGCGAGTGAAAGCGTAGA
CGACTACGGCAATTCTTTCATGCACTGGTATCAACAGAAGCCAGGCCAACCGCC
GAAGCTGCTTATCTATCGCGCGTCCAATTTGGAGTCAGGGATCCTGCACGATTT
TCAGGTTCTGGAAGTAGGACAGACTTTACACTTACGATAAACCCCGTGGAAGCG
GATGACGTCGCAACCTACTATTGTCAACAAAGCAATGAAGCACCACCTACCTTCG
GAGGTGGCACTAAATTGGAAATTAGGGGAAGCGGTGGATCAAACCCAATTTGCA
AGGGATGCCTGAGCTGTAGCAAGGACAACGGATGTTCACGGTGCCAGCAAAAGC
TGTTTTTCTTCCTCCGGGCCGAAGGAATGGCCGCATACGGCGAATGTCTCCACTC
CTGCCCCTCGGGGTATTACGGACACCGCGCCTGACATGAACCGATGCGCCAG
ATGCCGGATCGAGAACTGCGATAGCTGCCGCAGCAAGGACGCCTGCACTAAGTG
CAAAGTCGGCTTCTACCTTCACCGGGGCAGATGTTTTGACGAATGCCCGGATGGC
TTCGCCCCGCTGGAGGAGACTATGGAATGCGTGGAGGGCGGAGACTACAAGGAC
GACGATGACAAGGGCTCCCACCATCACCACCATCATCACCACTAG

Anti-TFR1, RSPO2 (R65A/R69A/Q70A/F105A/F109A) – polypeptide (SEQ ID NO: 22)

QVQLQQSGPELVRPGVSVKISCKGSGYTFTDYAMHWVKQSHAKSLEWIGGISTYFG
RTNYNQKFKGRATMTVDKSSSTAYMELARLTSEDSALYYCARGLSGNYVMDYWG
QGTSVTVSSGGGGSGGGGSGGGGSDIVLFQSPASLAVSLGQRATISCRASESVDDYG
NSFMHWYQQKPGQPPKLLIYRASNLESGIPARFSGSGSRTDFTLTINPVEADDVATYY
CQQSNEAPPTFGGGTKLEIRGSGGSNPICKGCLSCSKDNGCSRCQQKLFFFLRAEGM
AAYGECLHSCPSGYYGHRAPDMNRCARCRIENCDSCRSKDACTKCKVGFYLHRGR
CFDECPDGFAPLEETMECVEGGDYKDDDDKGSHHHHHHHH

FIGURE 1II

Fc-RSPO2 – polynucleotide (SEQ ID NO: 23)

GACAAAACTCACACATGCCCACCGTGCCCAGCACCTGAAGCCGCGGGGGGACCG
TCAGTCTTCCTCTTCCCCCCAAAACCCAAGGACACCCTCATGATCTCCCGGACCC
CTGAGGTCACATGCGTGGTGGTGGACGTGAGCCACGAAGACCCTGAGGTCAAGT
TCAACTGGTACGTGGACGGCGTGGAGGTGCATAATGCCAAGACAAAGCCGCGGG
AGGAGCAGTACAACAGCACGTACCGTGTGGTCAGCGTCCTCACCGTCCTGCACC
AGGACTGGCTGAATGGCAAGGAGTACAAGTGCAAGGTCTCCAACAAAGCCCTCG
GAGCCCCCATCGAGAAAACCATCTCCAAAGCCAAAGGGCAGCCCCGAGAACCAC
AGGTGTACACCCTGCCCCCATCCCGGGAGGAGATGACCAAGAACCAGGTCAGCC
TGACCTGCCTGGTCAAAGGCTTCTATCCCAGCGACATCGCCGTGGAGTGGGAGA
GCAATGGGCAGCCGGAGAACAACTACAAGACCACGCCTCCCGTGCTGGACTCCG
ACGGCTCCTTCTTCCTCTACAGCAAGCTCACCGTGGACAAGAGCAGGTGGCAGC
AGGGGAACGTCTTCTCATGCTCCGTGATGCATGAGGCTCTGCACAACCACTACAC
GCAGAAGAGCCTCTCCCTGTCTCCGGGTAAAGGTGGTGGTGGCTCGGGAGGAGG
AGGCTCCGGTGGCGGTGGCAGCtcaAATCCCATTTGCAAGGGTTGTTTGTCTTGTTC
AAAGGACAATGGGTGTAGCCGATGTCAACAGAAGTTGTTCTTCTTCCTTCGAAGA
GAAGGGATGCGCCAGTATGGAGAGTGCCTGCATTCCTGCCCATCCGGGTACTAT
GGACACCGAGCCCCAGATATGAACAGATGTGCAAGATGCAGAATAGAAAACTGT
GATTCTTGCTTTAGCAAAGACTTTTGTACCAAGTGCAAAGTAGGCTTTTATTTGCA
TAGAGGCCGTTGCTTTGATGAATGTCCAGATGGTTTTGCACCATTAGAAGAAACC
ATGGAATGTGTGGAATGA Fc-RSPO2 – polypeptide (SEQ ID NO: 24)

DKTHTCPPCPAPEAAGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALGAPI
EKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSP
GKGGGGSGGGGSGGGGSSNPICKGCLSCSKDNGCSRCQQKLFFFLRREGMRQYGEC
LHSCPSGYYGHRAPDMNRCARCRIENCDSCFSKDFCTKCKVGFYLHRGRCFDECPD
GFAPLEETMECVE

Anti-GFP light chain – polynucleotide (SEQ ID NO: 25)

GACATCGAACTCACCCAGCCCCCGTCAGTGTCCGTGGCCCCTGGACAGACTGCGC
GCATCTCCTGCTCCGGCGACAACCTGGGGAAGAAATACGTGTACTGGTACCAGC
AGAAGCCAGGTCAAGCCCCTGTGCTGGTCATCTACGGCGACGACGAAAGGCCGT
CAGGCATCCCAGAGCGCTTCTCCGGCTCCAACTCCGGGAATACTGCCACCCTTAC
CATTTCCGGAACCCAGGCCGAGGATGAAGCGGATTACTATTGCGCGAGCTACGA
TAGCAGCCACATCCTGATCGTGTTTGGAGGCGGTACCAAGCTTACCGTCCTAGGT
CAGCCCAAGGCTGCCCCCTCGGTCACTCTGTTCCCGCCCTCCTCTGAGGAGCTTC
AAGCCAACAAGGCCACACTGGTGTGTCTCATAAGTGACTTCTACCCGGGAGCCG
TGACAGTGGCCTGGAAGGCAGATAGCAGCCCCGTCAAGGCGGGAGTGGAGACC
ACCACACCCTCCAAACAAAGCAACAACAAGTACGCGGCCAGCAGCTATCTGAGC
CTGACGCCTGAGCAGTGGAAGTCCCACAGAAGCTACAGCTGCCAGGTCACGCAT
GAAGGGAGCACCGTGGAGAAGACAGTGGCCCCTACAGAATGTTCA

Anti-GFP light chain – polypeptide (SEQ ID NO: 26)

DIELTQPPSVSVAPGQTARISCSGDNLGKKYVYWYQQKPGQAPVLVIYGDDERPSGI
PERFSGSNSGNTATLTISGTQAEDEADYYCASYDSSHILIVFGGGTKLTVLGQPKAAP
SVTLFPPSSEELQANKATLVCLISDFYPGAVTVAWKADSSPVKAGVETTTPSKQSNN
KYAASSYLSLTPEQWKSHRSYSCQVTHEGSTVEKTVAPTECS

FIGURE 11K

RSPO2 (F105R/F109A), anti-GFP Heavy chain IgG2 – polynucleotide (SEQ ID NO: 27)

AACCCAATTTGCAAGGGATGCCTGAGCTGTAGCAAGGACAACGGATGTTCACGG
TGCCAGCAAAAGCTGTTTTTCTTCCTCCGGCGGGAAGGAATGCGGCAGTACGGC
GAATGTCTCCACTCCTGCCCCTCGGGGTATTACGGACACCGCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGAGGAGGAGGCTCCGGTGGCGGTGGCAGCCAGGTCCAGTTGGT
GGAATCCGGAGGGGGTTTGGTCCAGCCTGGTGGAAGCCTGCGCCTCTCATGCGC
CGCTAGCGGATTCACCTTCTCCCGATACGGCATGCATTGGGTCAGACAGGCACCC
GGAAAAGGACTCGAATGGGTGTCGGGCATTTCCTCGATCGGGTCAAACACCTAT
TACGCCGACTCCGTGAAGGGACGGTTCACCATTAGCCGGGATAACAGCAAGAAC
ACTCTGTACTTGCAAATGAACTCCCTGCGGGCTGAGGACACCGCCGTGTACTACT
GTGCGCGGTGGTACAAGACCTATATTGACGTCTGGGGACAGGGTACCCTCGTGA
CCGTGTCGAGTGCTAGCACCAAGGGCCCATCGGTCTTCCCCCTGGCGCCCTGCTC
CAGGAGCACCTCCGAGAGCACAGCGGCCCTGGGCTGCCTGGTCAAGGACTACTT
CCCCGAACCGGTGACGGTGTCGTGGAACTCAGGCGCTCTGACCAGCGGCGTGCA
CACCTTCCCAGCTGTCCTACAGTCCTCAGGACTCTACTCCTCAGCAGCGTGGTG
ACCGTGCCCTCCAGCAACTTCGGCACCCAGACCTACACCTGCAACGTAGATCACA
AGCCCAGCAACACCAAGGTGGACAAGACAGTTGAGCGCAAATGTTGTGTCGAGT
GCCCACCGTGCCCAGCACCACCTGTGGCAGGACCGTCAGTCTTCCTCTTCCCCCC
AAAACCCAAGGACACCCTCATGATCTCCCGGACCCCTGAGGTCACGTGCGTGGT
GGTGGACGTGAGCCACGAAGACCCCGAGGTCCAGTTCAACTGGTACGTGGACGG
CGTGGAGGTGCATAATGCCAAGACAAAGCCACGGGAGGAGCAGTTCAACAGCA
CGTTCCGTGTGGTCAGCGTCCTCACCGTTGTGCACCAGGACTGGCTGAACGGCAA
GGAGTACAAGTGCAAGGTCTCCAACAAAGGCCTCCAGCCCCCATCGAGAAAAC
CATCTCCAAAACCAAAGGGCAGCCCCGAGAACCACAGGTGTACACCCTGCCCCC
ATCCCGGGAGGAGATGACCAAGAACCAGGTCAGCCTGACCTGCCTGGTCAAAGG
CTTCTACCCCAGCGACATCGCCGTGGAGTGGGAGAGCAATGGGCAGCCGGAGAA
CAACTACAAGACCACGCCTCCCATGCTGGACTCCGACGGCTCCTTCTTCCTCTAC
AGCAAGCTCACCGTGGACAAGAGCAGGTGGCAGCAGGGGAACGTCTTCTCATGC
TCCGTGATGCATGAGGCTCTGCACAACCACTACACGCAGAAGAGCCTCTCCCTGT
CTCCGGGTAAA

RSPO2 (F105R/F109A), anti-GFP Heavy chain IgG2 – polypeptide (SEQ ID NO: 28)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GGGGSGGGGSQVQLVESGGGLVQPGGSLRLSCAASGFTFSRYGMHWVRQAPGKGL
EWVSGISSIGSNTYYADSVKGRFTISRDNSKNTLYLQMNSLRAEDTAVYYCARWYK
TYIDVWGQGTLVTVSSASTKGPSVFPLAPCSRSTSESTAALGCLVKDYFPEPVTVSW
NSGALTSGVHTFPAVLQSSGLYSLSSVVTVPSSNFGTQTYTCNVDHKPSNTKVDKTV
ERKCCVECPPCPAPPVAGPSVFLFPPKPKDTLMISRTPEVTCVVVDVSHEDPEVQFNW
YVDGVEVHNAKTKPREEQFNSTFRVVSVLTVVHQDWLNGKEYKCKVSNKGLPAPIE
KTISKTKGQPREPQVYTLPPSREEMTKNQVSLTCLVKGFYPSDIAVEWESNGQPENN
YKTTPPMLDSDGSFFLYSKLTVDKSRWQQGNVFSCSVMHEALHNHYTQKSLSLSPG
K

FIGURE 11L

Anti-ASGR1 light chain – polynucleotide (SEQ ID NO: 29)

GACATCGAGCTCACCCAGGACCCCGCTGTGTCCGTGGCCTTGGGACAGACCGTG
CGCATCACATGCCAGGGCGATAGCCTGCGGAGCTATTACGCCTCGTGGTACCAG
CAGAAGCCTGGTCAAGCGCCGGTCCTGGTCATCTACGGAAAGAACAACCGCCCG
TCCGGAATTCCAGACAGGTTCAGCGGATCCAGCTCGGGGAACACCGCCTCACTG
ACTATCACCGGAGCACAGGCCGAAGATGAAGCCGACTACTACTGCAACTCCCTG
GAGCGGATTGGATACCTGAGCTACGTGTTTGGTGGCGGTACCAAGCTTACCGTCC
TAGGTCAGCCCAAGGCTGCCCCCTCGGTCACTCTGTTCCCGCCCTCCTCTGAGGA
GCTTCAAGCCAACAAGGCCACACTGGTGTGTCTCATAAGTGACTTCTACCCGGGA
GCCGTGACAGTGGCCTGGAAGGCAGATAGCAGCCCCGTCAAGGCGGGAGTGGA
GACCACCACACCCTCCAAACAAAGCAACAACAAGTACGCGGCCAGCAGCTATCT
GAGCCTGACGCCTGAGCAGTGGAAGTCCCACAGAAGCTACAGCTGCCAGGTCAC
GCATGAAGGGAGCACCGTGGAGAAGACAGTGGCCCCTACAGAATGTTCA

Anti-ASGR1 light chain – polypeptide (SEQ ID NO: 30)

DIELTQDPAVSVALGQTVRITCQGDSLRSYYASWYQQKPGQAPVLVIYGKNNRPSGI
PDRFSGSSSGNTASLTITGAQAEDEADYYCNSLERIGYLSYVFGGGTKLTVLGQPKA
APSVTLFPPSSEELQANKATLVCLISDFYPGAVTVAWKADSSPVKAGVETTTPSKQSN
NKYAASSYLSLTPEQWKSHRSYSCQVTHEGSTVEKTVAPTECS

FIGURE 11M

RSPO2 (F105R/F109A), anti-ASGR1 Heavy chain IgG2 – polynucleotide (SEQ ID NO: 31)

AACCCAATTTGCAAGGGATGCCTGAGCTGTAGCAAGGACAACGGATGTTCACGG
TGCCAGCAAAAGCTGTTTTCTTCCTCCGGCGGGAAGGAATGCGGCAGTACGGC
GAATGTCTCCACTCCTGCCCCTCGGGGTATTACGGACACCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGAGGAGGAGGCTCCGGTGGCGGTGGCAGCGAAGTGCAGCTGCT
GGAATCCGGGGGCGGACTGGTGCAACCCGGGGGATCCCTCAGACTGTCCTGTGC
CGCATCGGGTTTCACTTTCTCCTCCTACGCGATGTCATGGGTCAGACAGGCCCCT
GGAAAAGGCCTCGAATGGGTGTCGGCTATCTCCGGATCGGGGGGATCTACTTAC
TACGCCGACTCCGTGAAGGGCCGGTTCACTATCTCGAGGGACAACTCCAAGAAT
ACCCTGTACTTGCAAATGAACTCCCTGCGCGCCGAGGATACCGCGGTGTATTACT
GCGCCAAGGACTTCAGCTCACGCCGGTGGTACCTTGAGTACTGGGGACAGGGAA
CCCTTGTCACCGTGTCGAGTGCTAGCACCAAGGGCCCATCGGTCTTCCCCCTGGC
GCCCTGCTCCAGGAGCACCTCCGAGAGCACAGCGGCCCTGGGCTGCCTGGTCAA
GGACTACTTCCCCGAACCGGTGACGGTGTCGTGGAACTCAGGCGCTCTGACCAG
CGGCGTGCACACCTTCCCAGCTGTCCTACAGTCCTCAGGACTCTACTCCCTCAGC
AGCGTGGTGACCGTGCCCTCCAGCAACTTCGGCACCCAGACCTACACCTGCAAC
GTAGATCACAAGCCCAGCAACACCAAGGTGGACAAGACAGTTGAGCGCAAATGT
TGTGTCGAGTGCCCACCGTGCCCAGCACCACCTGTGGCAGGACCGTCAGTCTTCC
TCTTCCCCCCAAAACCCAAGGACACCCTCATGATCTCCCGGACCCCTGAGGTCAC
GTGCGTGGTGGTGGACGTGAGCCACGAAGACCCCGAGGTCCAGTTCAACTGGTA
CGTGGACGGCGTGGAGGTGCATAATGCCAAGACAAAGCCACGGGAGGAGCAGT
TCAACAGCACGTTCCGTGTGGTCAGCGTCCTCACCGTTGTGCACCAGGACTGGCT
GAACGGCAAGGAGTACAAGTGCAAGGTCTCCAACAAAGGCCTCCCAGCCCCCAT
CGAGAAAACCATCTCCAAAACCAAAGGGCAGCCCCGAGAACCACAGGTGTACAC
CCTGCCCCCATCCCGGGAGGAGATGACCAAGAACCAGGTCAGCCTGACCTGCCT
GGTCAAAGGCTTCTACCCCAGCGACATCGCCGTGGAGTGGGAGAGCAATGGGCA
GCCGGAGAACAACTACAAGACCACGCCTCCCATGCTGGACTCCGACGGCTCCTT
CTTCCTCTACAGCAAGCTCACCGTGGACAAGAGCAGGTGGCAGCAGGGGAACGT
CTTCTCATGCTCCGTGATGCATGAGGCTCTGCACAACCACTACACGCAGAAGAGC
CTCTCCCTGTCTCCGGGTAAA

RSPO2 (F105R/F109A), anti-ASGR1 Heavy chain IgG2 – polypeptide (SEQ ID NO: 32)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GGGGSGGGGSEVQLLESGGGLVQPGGSLRLSCAASGFTFSSYAMSWVRQAPGKGLE
WVSAISGSGGSTYYADSVKGRFTISRDNSKNTLYLQMNSLRAEDTAVYYCAKDFSS
RRWYLEYWGQGTLVTVSSASTKGPSVFPLAPCSRSTSESTAALGCLVKDYFPEPVTV
SWNSGALTSGVHTFPAVLQSSGLYSLSSVVTVPSSNFGTQTYTCNVDHKPSNTKVDK
TVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLP
APIEKTISKTKGQPREPQVYTLPPSREEMTKNQVSLTCLVKGFYPSDIAVEWESNGQP
ENNYKTTPPMLDSDGSFFLYSKLTVDKSRWQQGNVFSCSVMHEALHNHYTQKSLSL
SPGK*

Anti-GFP Heavy chain IgG1 – polynucleotide (SEQ ID NO: 33)

CAGGTCCAGTTGGTGGAATCCGGAGGGGGTTTGGTCCAGCCTGGTGGAAGCCTG
CGCCTCTCATGCGCCGCTAGCGGATTCACCTTCTCCCGATACGGCATGCATTGGG
TCAGACAGGCACCCGGAAAAGGACTCGAATGGGTGTCGGGCATTTCCTCGATCG
GGTCAAACACCTATTACGCCGACTCCGTGAAGGGACGGTTCACCATTAGCCGGG
ATAACAGCAAGAACACTCTGTACTTGCAAATGAACTCCCTGCGGGCTGAGGACA
CCGCCGTGTACTACTGTGCGCGGTGGTACAAGACCTATATTGACGTCTGGGGACA
GGGTACCCTCGTGACCGTGTCGAGTGCTAGCACCAAGGGCCCATCGGTCTTCCCC
CTGGCACCCTCCTCCAAGAGCACCTCTGGGGGCACAGCGGCCCTGGGCTGCCTG
GTCAAGGACTACTTCCCCGAACCGGTGACGGTGTCGTGGAACTCAGGCGCCCTG
ACCAGCGGCGTGCACACCTTCCCGGCTGTCCTACAGTCCTCAGGACTCTACTCCC
TCAGCAGCGTGGTGACCGTGCCCTCCAGCAGCTTGGGCACCCAGACCTACATCTG
CAACGTGAATCACAAGCCCAGCAACACCAAGGTGGACAAGAAAGTTGAGCCCA
AATCTTGTGACAAAACTCACACATGCCCACCGTGCCCAGCACCTGAACTCCTGGG
GGGACCGTCAGTCTTCCTCTTCCCCCCAAAACCCAAGGACACCCTCATGATCTCC
CGGACCCCTGAGGTCACATGCGTGGTGGTGGACGTGAGCCACGAAGACCCTGAG
GTCAAGTTCAACTGGTACGTGGACGGCGTGGAGGTGCATAATGCCAAGACAAAG
CCGCGGGAGGAGCAGTACAACAGCACGTACCGTGTGGTCAGCGTCCTCACCGTC
CTGCACCAGGACTGGCTGAATGGCAAGGAGTACAAGTGCAAGGTCTCCAACAAA
GCCCTCCCAGCCCCATCGAGAAAACCATCTCCAAAGCCAAAGGGCAGCCCCGA
GAACCACAGGTGTACACCCTGCCCCCATCCCGGGAGGAGATGACCAAGAACCAG
GTCAGCCTGACCTGCCTGGTCAAAGGCTTCTATCCCAGCGACATCGCCGTGGAGT
GGGAGAGCAATGGGCAGCCGGAGAACAACTACAAGACCACGCCTCCCGTGCTGG
ACTCCGACGGCTCCTTCTTCCTCTACAGCAAGCTCACCGTGGACAAGAGCAGGTG
GCAGCAGGGGAACGTCTTCTCATGCTCCGTGATGCATGAGGCTCTGCACAACCAC
TACACGCAGAAGAGCCTCTCCCTGTCTCCGGGTAAATGA

Anti-GFP Heavy chain IgG1 – polypeptide (SEQ ID NO: 34)

QVQLVESGGGLVQPGGSLRLSCAASGFTFSRYGMHWVRQAPGKGLEWVSGISSIGS
NTYYADSVKGRFTISRDNSKNTLYLQMNSLRAEDTAVYYCARWYKTYIDVWGQGT
LVTVSSASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSCDKTHTC
PPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGK*

FIGURE 11O

Human ASGR1 Extracellular Domain – polynucleotide (SEQ ID NO: 35)

CAGAACAGCCAGCTCCAGGAAGAACTGAGGGGCCTCCGCGAAACCTTCTCCAAC
TTCACGGCTTCGACCGAAGCTCAAGTCAAGGGGTTGTCCACACAAGGCGGCAAC
GTCGGACGCAAGATGAAGTCGCTGGAGTCCCAGCTGGAAAAGCAGCAGAAGGA
TCTCTCCGAGGATCACAGCTCACTGCTGTTGCACGTGAAGCAGTTCGTGTCGGAC
CTGAGGTCCCTGAGCTGTCAGATGGCGGCACTGCAGGGAAACGGTTCCGAAAGA
ACTTGCTGCCTGTGAATTGGGTGGAGCACGAGAGAAGCTGCTACTGGTTCTCGC
GGTCCGGCAAAGCCTGGGCGGACGCCGACAACTATTGTCGGCTGGAGGATGCGC
ACCTGGTGGTCGTGACCTCCTGGGAGGAACAGAAGTTTGTGCAGCACCATATCG
GTCCCGTGAACACTTGGATGGGGCTGCACGACCAAAACGGACCGTGGAAATGGG
TGGATGGGACTGATTACGAAACCGGATTCAAGAACTGGCGCCCAGAGCAGCCCG
ACGATTGGTACGGACATGGACTGGGGGGCGGAGAGGACTGCGCCCACTTCACCG
ACGACGGCCGGTGGAACGACGACGTGTGCCAGCGGCCGTACCGCTGGGTCTGCG
AAACCGAGCTGGACAAGGCCAGCCAGGAGCCACCTCTCCTTTGA

Human ASGR1 Extracellular Domain – polypeptide (SEQ ID NO: 36)

QNSQLQEELRGLRETFSNFTASTEAQVKGLSTQGGNVGRKMKSLESQLEKQQKDLS
EDHSSLLLHVKQFVSDLRSLSCQMAALQGNGSERTCCPVNWVEHERSCYWFSRSGK
AWADADNYCRLEDAHLVVVTSWEEQKFVQHHIGPVNTWMGLHDQNGPWKWVDG
TDYETGFKNWRPEQPDDWYGHGLGGGEDCAHFTDDGRWNDDVCQRPYRWVCETE
LDKASQEPPLL

FIGURE 11P

Human ASGR2 Extracellular Domain – polynucleotide (SEQ ID NO: 37)

AGGGGCGCACAGCTGCAAGCCGAGCTGCGGTCCCTGAAGGAAGCTTTCTCAAAC
TTCTCGAGCTCGACCCTCACCGAAGTGCAGGCCATTAGCACCCACGGGGGTTCCG
TGGGGGACAAGATCACCTCGCTGGGAGCGAAGCTGGAGAAGCAGCAGCAAGAC
CTCAAGGCCGACCACGACGCGCTGCTGTTCCACTTGAAGCACTTCCCAGTGGACT
TGCGGTTCGTGGCGTGCCAGATGGAGCTGCTGCACTCCAATGGGAGCCAGAGAA
CTTGTTGCCCTGTGAACTGGGTGGAACACCAGGGATCCTGCTACTGGTTTAGCCA
CTCCGGAAAGGCCTGGGCCGAAGCCGAGAAGTACTGCCAGCTTGAGAACGCGCA
CCTGGTCGTGATCAACTCCTGGGAAGAACAGAAGTTCATTGTGCAACACACTAA
CCCGTTCAACACCTGGATCGGCCTGACCGACTCCGACGGCTCATGGAAATGGGT
GGACGGAACCGATTACCGGCATAACTATAAGAACTGGGCCGTGACTCAGCCGGA
TAATTGGCACGGACACGAGCTGGGTGGATCCGAGGACTGCGTCGAAGTGCAGCC
CGACGGCAGATGGAACGATGACTTCTGTCTGCAAGTGTACCGCTGGGTCTGCGA
GAAGCGCCGCAACGCCACTGGCGAAGTGGCTTGA

Human ASGR2 Extracellular Domain – polypeptide (SEQ ID NO: 38)

RGAQLQAELRSLKEAFSNFSSSTLTEVQAISTHGGSVGDKITSLGAKLEKQQQDLKA
DHDALLFHLKHFPVDLRFVACQMELLHSNGSQRTCCPVNWVEHQGSCYWFSHSGK
AWAEAEKYCQLENAHLVVINSWEEQKFIVQHTNPFNTWIGLTDSDGSWKWVDGTD
YRHNYKNWAVTQPDNWHGHELGGSEDCVEVQPDGRWNDDFCLQVYRWVCEKRR
NATGEVA

Cynomologous ASGR1 Extracellular Domain – polynucleotide (SEQ ID NO: 39)

CAAAACGCCCAGCTGCAGCGGGAGCTGCGGGGCCTGAGAGAGACGCTCAGCAA
CTTCACAGCGAGCACCGAGGCCCAGGTCAAGGGCTTGAGCACCCAGGGAGGCAA
TGTGGGAAGAAAGATGAAGTCGCTGGAGTCCCAGCTGGAGAAACAGCAGAAGG
ACTTGAGTGAAGATCACTCCAGCCTGCTGCTCCACGTGAAGCAGTTCGTGTCTGA
CCTGCGGAGCCTGAGCTGTCAGATGGCGGCGCTCCAGGGCAATGGCTCGGAAAG
GGCCTGCTGCCCAGTCAACTGGGTGGAGCACGAGCGCAGCTGCTACTGGTTCTCT
CGCTCCGGGAAGGCCTGGGCCGACGCCGACAACTACTGCCGGCTGGAGGACGCG
CACCTGGTGGTGGTCACGTCCTGGGAGGAGCAGAAATTTGTCCAGCACCACATA
GGTCCTGTGAACACCTGGATGGGCCTCCACGACCAAAACGGGCCCTGGAAGTGG
GTGGACGGGACGGACTACGAGACGGGCTTCAAGAACTGGAGACCGGAGCAGCC
GGACGACTGGTACGGCCACGGGCTCGGGGGAGGGGAGGACTGTGCCCACTTCAC
CGACGACGGCCGCTGGAACGACGACGTCTGCCAGAGGCCCTACCGCTGGGTCTG
CGAGACAGAGCTGGACAAGGCCAGTCAGGAGCCACCTCTCCTT

Cynomologous ASGR1 Extracellular Domain – polypeptide (SEQ ID NO: 40)

QNAQLQRELRGLRETLSNFTASTEAQVKGLSTQGGNVGRKMKSLESQLEKQQKDLS
EDHSSLLLHVKQFVSDLRSLSCQMAALQGNGSERACCPVNWVEHERSCYWFSRSGK
AWADADNYCRLEDAHLVVVTSWEEQKFVQHHIGPVNTWMGLHDQNGPWKWVDG
TDYETGFKNWRPEQPDDWYGHGLGGGEDCAHFTDDGRWNDDVCQRPYRWVCETE
LDKASQEPPLL

Cynomologous ASGR2 Extracellular Domain – polynucleotide (SEQ ID NO: 41)

CAAAGTGCACAGCTGCAAGCAGAGaTGcGGAGCCTGAAGGAAGCTTTCAGCAAC
TTCTCCTCGAGCACGCTGgTGGAGGTCCATGCTCTCGGCACCCACGGAGGCAGCG
TGGGTGACAAGATCACATCCTAGGAGACAAGTTGGAGAAACAGCAGCAcGACC
TGAAAGCAGATCATGACATCCTGCTCCTCCATCTGAAGCACTTCCCCGTGGACCT
GCGCTTCGTGGCCTGCCAGATGGAGCTCCTCCACAGCAACGGCTCCCAAAGGAC
CTGCTGCCCTGTCAACTGGGTGGAGCACCAAGGCAGCTGCTACTGGTTCTCTCGC
TCCGGGAAGGCCTGGGCCGAGGCGGAGAAGTACTGCCAGCTGGAGAACTCACAC
CTGGTGGTCATCAACTCCTGGGAGGAGCAGAAATTCATTGTACAACACACGAAC
CCCTTCAATACCTGGATAGGTCTCACGGACAGTGATGGCTCCTGGAAATGGGTGG
ACGGCACAGACTATAGGCACAACTACAAGAACTGGGCTGTCACTCAGCCAGATG
ATTGGCACGGGCATGAGCTGGGCGGAAGTGAAGACTGTGTTGAAGTCCGGCCGG
ATGGCCGCTGGAACGATGATTTCTGCCTGCAGGTGCACCGCTGGGTGTGTGAGA
AGAGGCGGAATGCCACCGGCGAGGCAGCCTGA

Cynomologous ASGR2 Extracellular Domain – polypeptide (SEQ ID NO: 42)

QSAQLQAEMRSLKEAFSNFSSSTLVEVHALGTHGGSVGDKITSLGDKLEKQQHDLK
ADHDILLLHLKHFPVDLRFVACQMELLHSNGSQRTCCPVNWVEHQGSCYWFSRSGK
AWAEAEKYCQLENSHLVVINSWEEQKFIVQHTNPFNTWIGLTDSDGSWKWVDGTD
YRHNYKNWAVTQPDDWHGHELGGSEDCVEVRPDGRWNDDFCLQVHRWVCEKRR
NATGEAA

FIGURE 11S

Human RNF43 Extracellular Domain – polynucleotide (SEQ ID NO: 43)

CAGAAAGCTATTATCAGAGTGATCCCCTTGAAAATGGACCCCACAGGAAAACTG
AATCTCACTTTGGAAGGTGTGTTTGCTGGTGTTGCTGAAATAACTCCAGCAGAAG
GAAAATTAATGCAGTCCCACCCGCTGTACCTGTGCAATGCCAGTGATGACGACA
ATCTGGAGCCTGGATTCATCAGCATCGTCAAGCTGGAGAGTCCTCGACGGGCCCC
CCGCCCCTGCCTGTCACTGGCTAGCAAGGCTCGGATGGCGGGTGAGCGAGGAGC
CAGTGCTGTCCTCTTTGACATCACTGAGGATCGAGCTGCTGCTGAGCAGCTGCAG
CAGCCGCTGGGGCTGACCTGGCCAGTGGTGTTGATCTGGGGTAATGACGCTGAG
AAGCTGATGGAGTTTGTGTACAAGAACCAAAAGGCCCATGTGAGGATTGAGCTG
AAGGAGCCCCCGGCCTGGCCAGATTATGATTGA

Human RNF43 Extracellular Domain – polypeptide (SEQ ID NO: 44)

QKAIIRVIPLKMDPTGKLNLTLEGVFAGVAEITPAEGKLMQSHPLYLCNASDDDNLEP
GFISIVKLESPRRAPRPCLSLASKARMAGERGASAVLFDITEDRAAAEQLQQPLGLTW
PVVLIWGNDAEKLMEFVYKNQKAHVRIELKEPPAWPDYD

FIGURE 11T

Human ZNRF3 Extracellular Domain – polynucleotide (SEQ ID NO: 45)

AAGGAGACGGCGTTCGTGGAGGTGGTGCTGTTCGAGTCGAGCCCAAGCGGCGAT
TACACCACCTACACCACCGGCCTCACGGGCCGCTTCTCGCGGGCCGGGGCCACG
CTCAGCGCCGAGGGCGAGATCGTGCAGATGCACCCACTGGGCCTATGTAATAAC
AATGACGAAGAGGACTTGTATGAATATGGCTGGGTAGGAGTGGTGAAGCTGGAA
CAGCCAGAATTGGACCCGAAACCATGCCTCACTGTCCTAGGCAAGGCCAAGCGA
GCAGTACAGCGGGGAGCTACTGCAGTCATCTTTGATGTGTCTGAAAACCCAGAA
GCTATTGATCAGCTGAACCAGGGCTCTGAAGACCCGCTCAAGAGGCCGGTGGTG
TATGTGAAGGGTGCAGATGCCATTAAGCTGATGAACATCGTCAACAAGCAGAAA
GTGGCTCGAGCAAGGATCCAGCACCGCCCTCCTCGACAACCCACTGAATACTTTG
ACATGTGA

Human ZNRF3 Extracellular Domain – polypeptide (SEQ ID NO: 46)

KETAFVEVVLFESSPSGDYTTYTTGLTGRFSRAGATLSAEGEIVQMHPLGLCNNNDE
EDLYEYGWVGVVKLEQPELDPKPCLTVLGKAKRAVQRGATAVIFDVSENPEAIDQL
NQGSEDPLKRPVVYVKGADAIKLMNIVNKQKVARARIQHRPPRQPTEYFDM

FIGURE 11U

Anti-β-Gal light chain – polynucleotide (SEQ ID NO: 155)

CAGAGCGTGTTAACCCAGCCCGCCAGCGTGAGCGGCAGCCCCGGCCAGAGCATC
ACCATCAGCTGCGCCGGCACCAGCAGCGACGTGGGCGGCTACAACTACGTGAGC
TGGTACCAGCAGCACCCCGGCAAGGCCCCCAAGCTGATGATCTACGAGGACAGC
AAGAGACCCAGCGGCGTGAGCAACAGATTCAGCGGCAGCAAGAGCGGCAACAC
CGCCAGCCTGACCATCAGCGGCCTGCAGGCCGAGGACGAGGCCGACTACTACTG
CAGCAGCTACACCACCAGAAGCACCAGAGTGTTCGGCGGCGGCACCAAGCTGGC
CGTGCTGGGTCAGCCCAAGGCTGCCCCTCGGTCACTCTGTTCCCGCCCTCCTCT
GAGGAGCTTCAAGCCAACAAGGCCACACTGGTGTGTCTCATAAGTGACTTCTACC
CGGGAGCCGTGACAGTGGCCTGGAAGGCAGATAGCAGCCCCGTCAAGGCGGGA
GTGGAGACCACCACACCCTCCAAACAAAGCAACAACAAGTACGCGGCCAGCAGC
TATCTGAGCCTGACGCCTGAGCAGTGGAAGTCCACAGAAGCTACAGCTGCCAG
GTCACGCATGAAGGGAGCACCGTGGAGAAGACAGTGGCCCCTACAGAATGTTCA

Anti-β-Gal light chain – polypeptide (SEQ ID NO: 156)

QSVLTQPASVSGSPGQSITISCAGTSSDVGGYNYVSWYQQHPGKAPKLMIYEDSKRP
SGVSNRFSGSKSGNTASLTISGLQAEDEADYYCSSYTTRSTRVFGGGTKLAVLGQPK
AAPSVTLFPPSSEELQANKATLVCLISDFYPGAVTVAWKADSSPVKAGVETTTPSKQS
NNKYAASSYLSLTPEQWKSHRSYSCQVTHEGSTVEKTVAPTECS

FIGURE 11V

Anti-β-Gal Heavy chain IgG1-LALAPG – polynucleotide (SEQ ID NO: 157)

GAGGTGCAGCTGGTGGAGAGCGGCGGCAGCCTGGTGAAGCCCGGCGGCAGCCTG
AGACTGAGCTGCGCCGCCAGCGGCTTCACCTTCAGCAACTACAGCATGAACTGG
GTGAGACAGGCCCCCGGCAAGGGCCTGGAGTGGATCAGCAGCATCAGCGGCAGC
AGCAGATACATCTACTACGCCGACTTCGTGAAGGGCAGATTCACCATCAGCAGA
GACAACGCCACCAACAGCCTGTACCTGCAGATGAACAGCCTGAGAGCCGAGGAC
ACCGCCGTGTACTACTGCGTGAGAAGCAGCATCACCATCTTCGGCGGCGGCATG
GACGTGTGGGGCAGAGGCACCCTGGTGACCGTGAGCAGCGCTAGCACCAAGGGC
CCATCGGTCTTCCCCCTGGCACCCTCCTCCAAGAGCACCTCTGGGGGCACAGCGG
CCCTGGGCTGCCTGGTCAAGGACTACTTCCCCGAACCGGTGACGGTGTCGTGGAA
CTCAGGCGCCCTGACCAGCGGCGTGCACACCTTCCCGGCTGTCCTACAGTCCTCA
GGACTCTACTCCCTCAGCAGCGTGGTGACCGTGCCCTCCAGCAGCTTGGGCACCC
AGACCTACATCTGCAACGTGAATCACAAGCCCAGCAACACCAAGGTGGACAAGA
AAGTTGAGCCCAAATCTTGTGACAAAACTCACACATGCCCACCGTGCCCAGCAC
CTGAAGCCGCGGGGGGACCGTCAGTCTTCCTCTTCCCCCCAAAACCCAAGGACA
CCCTCATGATCTCCCGGACCCCTGAGGTCACATGCGTGGTGGTGGACGTGAGCCA
CGAAGACCCTGAGGTCAAGTTCAACTGGTACGTGGACGGCGTGGAGGTGCATAA
TGCCAAGACAAAGCCGCGGGAGGAGCAGTACAACAGCACGTACCGTGTGGTCAG
CGTCCTCACCGTCCTGCACCAGGACTGGCTGAATGGCAAGGAGTACAAGTGCAA
GGTCTCCAACAAAGCCCTCGGAGCCCCATCGAGAAAACCATCTCCAAAGCCAA
AGGGCAGCCCCGAGAACCACAGGTGTACACCCTGCCCCCATCCCGGGAGGAGAT
GACCAAGAACCAGGTCAGCCTGACCTGCCTGGTCAAAGGCTTCTATCCCAGCGA
CATCGCCGTGGAGTGGGAGAGCAATGGGCAGCCGGAGAACAACTACAAGACCA
CGCCTCCCGTGCTGGACTCCGACGGCTCCTTCTTCCTCTACAGCAAGCTCACCGT
GGACAAGAGCAGGTGGCAGCAGGGGAACGTCTTCTCATGCTCCGTGATGCATGA
GGCTCTGCACAACCACTACACGCAGAAGAGCCTCTCCCTGTCTCCGGGTAAA

Anti-β-Gal Heavy chain IgG1-LALAPG – polypeptide (SEQ ID NO: 158)

EVQLVESGGSLVKPGGSLRLSCAASGFTFSNYSMNWVRQAPGKGLEWISSISGSSRYI
YYADFVKGRFTISRDNATNSLYLQMNSLRAEDTAVYYCVRSSITIFGGGMDVWGRG
TLVTVSSASTKGPSVFPLAPSSKSTSGGTAALGCLVKDYFPEPVTVSWNSGALTSGV
HTFPAVLQSSGLYSLSSVVTVPSSSLGTQTYICNVNHKPSNTKVDKKVEPKSCDKTHT
CPPCPAPEAAGGPSVFLFPPKPKDTLMISRTPEVTCVVVDVSHEDPEVKFNWYVDGV
EVHNAKTKPREEQYNSTYRVVSVLTVLHQDWLNGKEYKCKVSNKALGAPIEKTISK
AKGQPREPQVYTLPPSREEMTKNQVSLTCLVKGFYPSDIAVEWESNGQPENNYKTTP
PVLDSDGSFFLYSKLTVDKSRWQQGNVFSCSVMHEALHNHYTQKSLSLSPGK

FIGURE 11W

Anti-β-Gal Heavy chain IgG2 – polynucleotide (SEQ ID NO: 159)

GAGGTGCAGCTGGTGGAGAGCGGCGGCAGCCTGGTGAAGCCCGGCGGCAGCCTG
AGACTGAGCTGCGCCGCCAGCGGCTTCACCTTCAGCAACTACAGCATGAACTGG
GTGAGACAGGCCCCCGGCAAGGGCCTGGAGTGGATCAGCAGCATCAGCGGCAGC
AGCAGATACATCTACTACGCCGACTTCGTGAAGGGCAGATTCACCATCAGCAGA
GACAACGCCACCAACAGCCTGTACCTGCAGATGAACAGCCTGAGAGCCGAGGAC
ACCGCCGTGTACTACTGCGTGAGAAGCAGCATCACCATCTTCGGCGGCGGCATG
GACGTGTGGGGCAGAGGCACCCTGGTGACCGTGAGCAGCGCTAGCACCAAGGGC
CCATCGGTCTTCCCCCTGGCGCCCTGCTCCAGGAGCACCTCCGAGAGCACAGCGG
CCCTGGGCTGCCTGGTCAAGGACTACTTCCCCGAACCGGTGACGGTGTCGTGGAA
CTCAGGCGCTCTGACCAGCGGCGTGCACACCTTCCCAGCTGTCCTACAGTCCTCA
GGACTCTACTCCCTCAGCAGCGTGGTGACCGTGCCCTCCAGCAACTTCGGCACCC
AGACCTACACCTGCAACGTAGATCACAAGCCCAGCAACACCAAGGTGGACAAGA
CAGTTGAGCGCAAATGTTGTGTCGAGTGCCCACCGTGCCCAGCACCACCTGTGGC
AGGACCGTCAGTCTTCCTCTTCCCCCCAAAACCCAAGGACACCCTCATGATCTCC
CGGACCCCTGAGGTCACGTGCGTGGTGGTGGACGTGAGCCACGAAGACCCCGAG
GTCCAGTTCAACTGGTACGTGGACGGCGTGGAGGTGCATAATGCCAAGACAAAG
CCACGGGAGGAGCAGTTCAACAGCACGTTCCGTGTGGTCAGCGTCCTCACCGTTG
TGCACCAGGACTGGCTGAACGGCAAGGAGTACAAGTGCAAGGTCTCCAACAAAG
GCCTCCCAGCCCCCATCGAGAAAACCATCTCCAAAACCAAAGGGCAGCCCCGAG
AACCACAGGTGTACACCCTGCCCCCATCCCGGGAGGAGATGACCAAGAACCAGG
TCAGCCTGACCTGCCTGGTCAAAGGCTTCTACCCCAGCGACATCGCCGTGGAGTG
GGAGAGCAATGGGCAGCCGGAGAACAACTACAAGACCACGCCTCCCATGCTGGA
CTCCGACGGCTCCTTCTTCCTCTACAGCAAGCTCACCGTGGACAAGAGCAGGTGG
CAGCAGGGGAACGTCTTCTCATGCTCCGTGATGCATGAGGCTCTGCACAACCACT
ACACGCAGAAGAGCCTCTCCCTGTCTCCGGGTAAA

Anti-β-Gal Heavy chain IgG2 – polypeptide (SEQ ID NO: 160)

EVQLVESGGSLVKPGGSLRLSCAASGFTFSNYSMNWVRQAPGKGLEWISSISGSSRYI
YYADFVKGRFTISRDNATNSLYLQMNSLRAEDTAVYYCVRSSITIFGGGMDVWGRG
TLVTVSSASTKGPSVFPLAPCSRSTSESTAALGCLVKDYFPEPVTVSWNSGALTSGVH
TFPAVLQSSGLYSLSSVVTVPSSNFGTQTYTCNVDHKPSNTKVDKTVERKCCVECPP
CPAPPVAGPSVFLFPPKPKDTLMISRTPEVTCVVVDVSHEDPEVQFNWYVDGVEVHN
AKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDS
DGSFFLYSKLTVDKSRWQQGNVFSCSVMHEALHNHYTQKSLSLSPGK*

FIGURE 11X

Anti-ASGR1 VH-CH1 – polynucleotide (SEQ ID NO: 161)

GAAGTGCAGCTGCTGGAATCCGGGGGCGGACTGGTGCAACCCGGGGGATCCCTC
AGACTGTCCTGTGCCGCATCGGGTTTCACTTTCTCCTCCTACGCGATGTCATGGGT
CAGACAGGCCCCTGGAAAAGGCCTCGAATGGGTGTCGGCTATCTCCGGATCGGG
GGGATCTACTTACTACGCCGACTCCGTGAAGGGCCGGTTCACTATCTCGAGGGAC
AACTCCAAGAATACCCTGTACTTGCAAATGAACTCCCTGCGCGCCGAGGATACC
GCGGTGTATTACTGCGCCAAGGACTTCAGCTCACGCCGGTGGTACCTTGAGTACT
GGGGACAGGGAACCCTTGTCACCGTGTCCAGCGCTAGCACCAAGGGCCCATCGG
TCTTCCCCCTGGCACCCTCCTCCAAGAGCACCTCTGGGGGCACAGCGGCCCTGGG
CTGCCTGGTCAAGGACTACTTCCCCGAACCGGTGACGGTGTCGTGGAACTCAGGC
GCCCTGACCAGCGGCGTGCACACCTTCCCGGCTGTCCTACAGTCCTCAGGACTCT
ACTCCCTCAGCAGCGTGGTGACCGTGCCCTCCAGCAGCTTGGGCACCCAGACCTA
CATCTGCAACGTGAATCACAAGCCCAGCAACACCAAGGTGGACAAGAAAGTTGA
GCCCAAATCTTGTGGATCCGGCTCCGGACATCATCATCACCATCAC

Anti-ASGR1 VH-CH1 – polynpeptide (SEQ ID NO: 162)

EVQLLESGGGLVQPGGSLRLSCAASGFTFSSYAMSWVRQAPGKGLEWVSAISGSGG
STYYADSVKGRFTISRDNSKNTLYLQMNSLRAEDTAVYYCAKDFSSRRWYLEYWG
QGTLVTVSSASTKGPSVFPLAPSSKSTSGGTAALGCLVKDYFPEPVTVSWNSGALTS
GVHTFPAVLQSSGLYSLSSVVTVPSSSLGTQTYICNVNHKPSNTKVDKKVEPKSCGS
GSGHHHHHH

Murine ASGR1 Extracellular Domain – polynucleotide (SEQ ID NO: 163)

CAAAATTCCCAACTCCGGGAAGATCTGCTGGCTCTAAGGCAGAATTTCAGCAAC
CTCACTGTGAGCACTGAGGACCAGGTCAAGGCCCTGAGCACCCAGGGAAGTAGT
GTGGGAAGAAAGATGAAGTTAGTGGAGTCGAAGCTGGAAAAACAGCAGAAGGA
TCTGACTGAAGATCACTCCAGTTTGCTACTGCACGTGAAGCAGTTAGTGTCTGAC
GTGCGAAGCTTGAGCTGCCAGATGGCTGCATTTCGGGGCAATGGCTCTGAAAGG
ACCTGCTGCCCCATCAACTGGGTGGAGTATGAAGGCAGCTGCTACTGGTTCTCCA
GCTCTGTGAGGCCTTGGACTGAAGCTGACAAGTACTGCCAGCTGGAAAATGCCC
ATCTGGTGGTGGTGACCTCCAGGGATGAGCAGAACTTCCTCCAGCGCCACATGG
GCCCCTTAAACACTTGGATTGGCCTAACTGACCAGAACGGGCCCTGGAAATGGG
TGGATGGAACAGACTACGAGACAGGCTTCCAGAATTGGAGACCAGAGCAGCCAG
ATAACTGGTACGGACATGGGCTTGGAGGAGGCGAGGACTGTGCCCACTTCACGA
CGGATGGCCGCTGGAATGACGACGTCTGCAGGAGGCCCTACCGCTGGGTCTGTG
AGACAAAGTTGGATAAGGCTAATTCCGGCTCCGGAGGTCTTAATGATATTTTCGA
GGCTCAGAAGATTGAGTGGCATGAAGGATCCGGCTCCCACCACCATCATCACCA
CCACCAC

Murine ASGR1 Extracellular Domain – polypeptide (SEQ ID NO: 164)

QNSQLREDLLALRQNFSNLTVSTEDQVKALSTQGSSVGRKMKLVESKLEKQQKDLT
EDHSSLLLHVKQLVSDVRSLSCQMAAFRGNGSERTCCPINWVEYEGSCYWFSSSVRP
WTEADKYCQLENAHLVVVTSRDEQNFLQRHMGPLNTWIGLTDQNGPWKWVDGTD
YETGFQNWRPEQPDNWYGHGLGGGEDCAHFTTDGRWNDDVCRRPYRWVCETKLD
KANSGSGGLNDIFEAQKIEWHEGSGSHHHHHHHH

FIGURE 11Z

Anti-β-Gal Heavy chain IgG2, RSPO2 (F105R/F109A) polynucleotide (SID NO: 186)

GAGGTGCAGCTGGTGGAGAGCGGCGGCAGCCTGGTGAAGCCCGGCGGCAGCCTG
AGACTGAGCTGCGCCGCCAGCGGCTTCACCTTCAGCAACTACAGCATGAACTGG
GTGAGACAGGCCCCCGGCAAGGGCCTGGAGTGGATCAGCAGCATCAGCGGCAGC
AGCAGATACATCTACTACGCCGACTTCGTGAAGGGCAGATTCACCATCAGCAGA
GACAACGCCACCAACAGCCTGTACCTGCAGATGAACAGCCTGAGAGCCGAGGAC
ACCGCCGTGTACTACTGCGTGAGAAGCAGCATCACCATCTTCGGCGGCGGCATG
GACGTGTGGGGCAGAGGCACCCTGGTGACCGTGAGCAGCGCTAGCACCAAGGGC
CCATCGGTCTTCCCCCTGGCGCCCTGCTCCAGGAGCACCTCCGAGAGCACAGCGG
CCCTGGGCTGCCTGGTCAAGGACTACTTCCCCGAACCGGTGACGGTGTCGTGGAA
CTCAGGCGCTCTGACCAGCGGCGTGCACACCTTCCCAGCTGTCCTACAGTCCTCA
GGACTCTACTCCCTCAGCAGCGTGGTGACCGTGCCCTCCAGCAACTTCGGCACCC
AGACCTACACCTGCAACGTAGATCACAAGCCCAGCAACACCAAGGTGGACAAGA
CAGTTGAGCGCAAATGTTGTGTCGAGTGCCCACCGTGCCCAGCACCACCTGTGGC
AGGACCGTCAGTCTTCCTCTTCCCCCCAAAACCCAAGGACACCCTCATGATCTCC
CGGACCCCTGAGGTCACGTGCGTGGTGGTGGACGTGAGCCACGAAGACCCCGAG
GTCCAGTTCAACTGGTACGTGGACGGCGTGGAGGTGCATAATGCCAAGACAAAG
CCACGGGAGGAGCAGTTCAACAGCACGTTCCGTGTGGTCAGCGTCCTCACCGTTG
TGCACCAGGACTGGCTGAACGGCAAGGAGTACAAGTGCAAGGTCTCCAACAAAG
GCCTCCCAGCCCCCATCGAGAAAACCATCTCCAAAACCAAAGGGCAGCCCCGAG
AACCACAGGTGTACACCCTGCCCCCATCCCGGGAGGAGATGACCAAGAACCAGG
TCAGCCTGACCTGCCTGGTCAAAGGCTTCTACCCCAGCGACATCGCCGTGGAGTG
GGAGAGCAATGGGCAGCCGGAGAACAACTACAAGACCACGCCTCCCATGCTGGA
CTCCGACGGCTCCTTCTTCCTCTACAGCAAGCTCACCGTGGACAAGAGCAGGTGG
CAGCAGGGGAACGTCTTCTCATGCTCCGTGATGCATGAGGCTCTGCACAACCACT
ACACGCAGAAGAGCCTCTCCCTGTCTCCGGGTAAAGGTGGTGGTGGCTCGGGAT
CCGGAGGCTCCGGTGGCGGTGGCAGCAACCCAATTTGCAAGGGATGCTTAAGCT
GTAGCAAGGACAACGGATGTTCACGGTGCCAGCAAAAGCTGTTTTTCTTCCTCCG
GCGGGAAGGAATGCGGCAGTACGGCGAATGTCTCCACTCCTGCCCCTCGGGGTA
TTACGGACACCGCGCGCCTGACATGAACCGATGCGCCAGATGCCGGATCGAGAA
CTGCGATAGCTGCCGCAGCAAGGACGCCTGCACTAAGTGCAAAGTCGGCTTCTA
CCTTCACCGGGGCAGATGTTTTGACGAATGCCCGGATGGCTTCGCCCCGCTGGAG
GAGACTATGGAATGCGTGGAG

Anti-β-Gal Heavy chain IgG2, RSPO2 (F105R/F109A) polypeptide (SEQ ID NO: 187)

EVQLVESGGSLVKPGGSLRLSCAASGFTFSNYSMNWVRQAPGKGLEWISSISGSSRYI
YYADFVKGRFTISRDNATNSLYLQMNSLRAEDTAVYYCVRSSITIFGGGMDVWGRG
TLVTVSSASTKGPSVFPLAPCSRSTSESTAALGCLVKDYFPEPVTVSWNSGALTSGVH
TFPAVLQSSGLYSLSSVVTVPSSNFGTQTYTCNVDHKPSNTKVDKTVERKCCVECPP
CPAPPVAGPSVFLFPPKPKDTLMISRTPEVTCVVVDVSHEDPEVQFNWYVDGVEVHN
AKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDS
DGSFFLYSKLTVDKSRWQQGNVFSCSVMHEALHNHYTQKSLSLSPGKGGGGSGSGG
SGGGGSNPICKGCLSCSKDNGCSRCQQKLFFFLRREGMRQYGECLHSCPSGYYGHR
APDMNRCARCRIENCDSCRSKDACTKCKVGFYLHRGRCFDECPDGFAPLEETMECV
E

FIGURE 11AA

Anti-GFP Heavy chain IgG2, RSPO2 (F105R/F109A) polynucleotide (SEQ ID NO: 188)

CAGGTCCAGTTGGTGGAATCCGGAGGGGGTTTGGTCCAGCCTGGTGGAAGCCTG
CGCCTCTCATGCGCCGCTAGCGGATTCACCTTCTCCCGATACGGCATGCATTGGG
TCAGACAGGCACCCGGAAAAGGACTCGAATGGGTGTCGGGCATTTCCTCGATCG
GGTCAAACACCTATTACGCCGACTCCGTGAAGGGACGGTTCACCATTAGCCGGG
ATAACAGCAAGAACACTCTGTACTTGCAAATGAACTCCCTGCGGGCTGAGGACA
CCGCCGTGTACTACTGTGCGCGGTGGTACAAGACCTATATTGACGTCTGGGGACA
GGGTACCCTCGTGACCGTGTCTAGCGCTAGCACCAAGGGCCCATCGGTCTTCCCC
CTGGCACCCTCCTCCAAGAGCACCTCTGGGGGCACAGCGGCCCTGGGCTGCCTG
GTCAAGGACTACTTCCCCGAACCGGTGACGGTGTCGTGGAACTCAGGCGCCCTG
ACCAGCGGCGTGCACACCTTCCCGGCTGTCCTACAGTCCTCAGGACTCTACTCCC
TCAGCAGCGTGGTGACCGTGCCCTCCAGCAGCTTGGGCACCCAGACCTACATCTG
CAACGTGAATCACAAGCCCAGCAACACCAAGGTGGACAAGAAAGTTGAGCCCA
AATCTTGTGACAAAACTCACACATGCCCACCGTGCCCAGCACCTGAACTCCTGGG
GGGACCGTCAGTCTTCCTCTTCCCCCCAAAACCCAAGGACACCCTCATGATCTCC
CGGACCCCTGAGGTCACATGCGTGGTGGTGGACGTGAGCCACGAAGACCCTGAG
GTCAAGTTCAACTGGTACGTGGACGGCGTGGAGGTGCATAATGCCAAGACAAAG
CCGCGGGAGGAGCAGTACGGCAGCACGTACCGTGTGGTCAGCGTCCTCACCGTC
CTGCACCAGGACTGGCTGAATGGCAAGGAGTACAAGTGCAAGGTCTCCAACAAA
GCCCTCCCAGCCCCCATCGAGAAAACCATCTCCAAAGCCAAAGGGCAGCCCCGA
GAACCACAGGTGTACACCCTGCCCCCATCCCGGGAGGAGATGACCAAGAACCAG
GTCAGCCTGACCTGCCTGGTCAAAGGCTTCTATCCAGCGACATCGCCGTGGAGT
GGGAGAGCAATGGGCAGCCGGAGAACAACTACAAGACCACGCCTCCCGTGCTGG
ACTCCGACGGCTCCTTCTTCCTCTACAGCAAGCTCACCGTGGACAAGAGCAGGTG
GCAGCAGGGGAACGTCTTCTCATGCTCCGTGATGCATGAGGCTCTGCACAACCAC
TACACGCAGAAGAGCCTCTCCCTGTCTCCGGGTAAAGGTGGTGGTGGCTCGGGA
TCCGGAGGCTCCGGTGGCGGTGGCAGCAACCCAATTTGCAAGGGATGCTTAAGC
TGTAGCAAGGACAACGGATGTTCACGGTGCCAGCAAAAGCTGTTTTTCTTCCTCC
GGCGGGAAGGAATGCGGCAGTACGGCGAATGTCTCCACTCCTGCCCCTCGGGGT
ATTACGGACACCGCGCGCCTGACATGAACCGATGCGCCAGATGCCGGATCGAGA
ACTGCGATAGCTGCCGCAGCAAGGACGCCTGCACTAAGTGCAAAGTCGGCTTCT
ACCTTCACCGGGGCAGATGTTTTGACGAATGCCCGGATGGCTTCGCCCCGCTGGA
GGAGACTATGGAATGCGTGGAG

Anti-GFP Heavy chain IgG2, RSPO2 (F105R/F109A) polypeptide (SEQ ID NO: 189)

QVQLVESGGGLVQPGGSLRLSCAASGFTFSRYGMHWVRQAPGKGLEWVSGISSIGS
NTYYADSVKGRFTISRDNSKNTLYLQMNSLRAEDTAVYYCARWYKTYIDVWGQGT
LVTVSSASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSCDKTHTC
PPCPAPELLGGPSVFLFPPKPKDTLMISRTPEVTCVVVDVSHEDPEVKFNWYVDGVE
VHNAKTKPREEQYGSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPP
VLDSDGSFFLYSKLTVDKSRWQQGNVFSCSVMHEALHNHYTQKSLSLSPGKGGGGS
GSGGSGGGGSNPICKGCLSCSKDNGCSRCQQKLFFFLRREGMRQYGECLHSCPSGYY
GHRAPDMNRCARCRIENCDSCRSKDACTKCKVGFYLHRGRCFDECPDGFAPLEETM
ECVE

FIGURE 11AB

LP1-1F8 light chain polynucleotide (SEQ ID NO: 190)

GACATTGTGATGTCACAGTCTCCATCCTCCCTGGCTGTGTCAGCAGGAGAGAAGG
TCACTATGAGCTGCAAGTCCAGTCAGAGTCTGTTCAACAGTAGAACCCGAAAGA
ACTACTTGGCTTGGTACCAGCAGAAACCAGGGCAGTCTCCTAAACTGCTGATCTA
CTGGGCATCCACTAGGGAATCTGGGGTCCCTGATCGCTTCACAGGCAGTGGATCT
GGGACAGATTTCACTCTCACCATCAGCAGTGTGCAGGCTGAAGACCTGGCAGTTT
ATTACTGCAAGCAATCTTATTATCTGCTCACGTTCGGTGCTGGGACCAAGCTGGA
GCTGAAACGTACGGTGGCTGCACCATCTGTCTTCATCTTCCCGCCATCTGATGAG
CAGTTGAAATCTGGAACTGCCTCTGTTGTGTGCCTGCTGAATAACTTCTATCCCA
GAGAGGCCAAAGTACAGTGGAAGGTGGATAACGCCCTCCAATCGGGTAACTCCC
AGGAGAGTGTCACAGAGCAGGACAGCAAGGACAGCACCTACAGCCTCAGCAGC
ACCCTGACGCTGAGCAAAGCAGACTACGAGAAACACAAAGTCTACGCCTGCGAA
GTCACCCATCAGGGCCTGAGCTCGCCCGTCACAAAGAGCTTCAACAGGGGAGAG
TGT

LP1-1F8 light chain polypeptide (SEQ ID NO: 191)

DIVMSQSPSSLAVSAGEKVTMSCKSSQSLFNSRTRKNYLAWYQQKPGQSPKLLIYW
ASTRESGVPDRFTGSGSGTDFTLTISSVQAEDLAVYYCKQSYYLLTFGAGTKLELKRT
VAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC

FIGURE 11AC

LP1-1F8 Heavy chain IgG2, RSPO2 (F105R/F109A) polynucleotide (SEQ ID NO: 192)

GAAGTGAAACTGGTGGAGTCTGGGGGAGGCTTAGTGAAGCCTGGAGGGTCCCTG
AAACTCTCCTGTGCAGCCTCTGGATTCACTTTCAGTACCTATACCATGTCTTGGGT
TCGCCAGACTCCGGCGAAGAGGCTGGAGTGGGTCGCAACCATTAGTAGTATTGG
TGTTAACACCTACTATCCAGACAGTGTGAAGGGCCGATTCACCATCTCCAGAGAC
AATGCCAGGAACACCCTGTACCTGCAAGTGAGCAGTCTGAGGTCTGAGGACACG
GCCATGTATTACTGTGCAAGACATGTGGATTACTACGATGGGATTTCCTTTGACT
ACTGGGGCCAAGGCACCACTCTCACAGTCTCCAGCGCTAGCACCAAGGGCCCAT
CGGTCTTCCCCCTGGCGCCCTGCTCCAGGAGCACCTCCGAGAGCACAGCGGCCCT
GGGCTGCCTGGTCAAGGACTACTTCCCCGAACCGGTGACGGTGTCGTGGAACTC
AGGCGCTCTGACCAGCGGCGTGCACACCTTCCCAGCTGTCCTACAGTCCTCAGGA
CTCTACTCCCTCAGCAGCGTGGTGACCGTGCCCTCCAGCAACTTCGGCACCCAGA
CCTACACCTGCAACGTAGATCACAAGCCCAGCAACACCAAGGTGGACAAGACAG
TTGAGCGCAAATGTTGTGTCGAGTGCCCACCGTGCCCAGCACCACCTGTGGCAGG
ACCGTCAGTCTTCCTCTTCCCCCCAAAACCCAAGGACACCCTCATGATCTCCCGG
ACCCCTGAGGTCACGTGCGTGGTGGTGGACGTGAGCCACGAAGACCCCGAGGTC
CAGTTCAACTGGTACGTGGACGGCGTGGAGGTGCATAATGCCAAGACAAAGCCA
CGGGAGGAGCAGTTCAACAGCACGTTCCGTGTGGTCAGCGTCCTCACCGTTGTGC
ACCAGGACTGGCTGAACGGCAAGGAGTACAAGTGCAAGGTCTCCAACAAAGGCC
TCCCAGCCCCCATCGAGAAAACCATCTCCAAAACCAAAGGGCAGCCCCGAGAAC
CACAGGTGTACACCCTGCCCCCATCCCGGGAGGAGATGACCAAGAACCAGGTCA
GCCTGACCTGCCTGGTCAAAGGCTTCTACCCCAGCGACATCGCCGTGGAGTGGG
AGAGCAATGGGCAGCCGGAGAACAACTACAAGACCACGCCTCCCATGCTGGACT
CCGACGGCTCCTTCTTCCTCTACAGCAAGCTCACCGTGGACAAGAGCAGGTGGCA
GCAGGGGAACGTCTTCTCATGCTCCGTGATGCATGAGGCTCTGCACAACCACTAC
ACGCAGAAGAGCCTCTCCCTGTCTCCGGGTAAAGGTGGTGGTGGCTCGGGATCC
GGAGGCTCCGGTGGCGGTGGCAGCAACCCAATTTGCAAGGGATGCTTAAGCTGT
AGCAAGGACAACGGATGTTCACGGTGCCAGCAAAAGCTGTTTTTCTTCCTCCGGC
GGGAAGGAATGCGGCAGTACGGCGAATGTCTCCACTCCTGCCCCTCGGGGTATT
ACGGACACCGCGCCTGACATGAACCGATGCGCCAGATGCCGGATCGAGAACT
GCGATAGCTGCCGCAGCAAGGACGCCTGCACTAAGTGCAAAGTCGGCTTCTACC
TTCACCGGGGCAGATGTTTTGACGAATGCCCGGATGGCTTCGCCCCGCTGGAGGA
GACTATGGAATGCGTGGAG

LP1-1F8 Heavy chain IgG2, RSPO2 (F105R/F109A) polypeptide (SEQ ID NO: 193)

EVKLVESGGGLVKPGGSLKLSCAASGFTFSTYTMSWVRQTPAKRLEWVATISSIGVN
TYYPDSVKGRFTISRDNARNTLYLQVSSLRSEDTAMYYCARHVDYYDGISFDYWGQ
GTTLTVSSASTKGPSVFPLAPCSRSTSESTAALGCLVKDYFPEPVTVSWNSGALTSGV
HTFPAVLQSSGLYSLSSVVTVPSSNFGTQTYTCNVDHKPSNTKVDKTVERKCCVECP
PCPAPPVAGPSVFLFPPKPKDTLMISRTPEVTCVVVDVSHEDPEVQFNWYVDGVEVH
NAKTKPREEQFNSTFRVVSVLTVVHQDWLNGKEYKCKVSNKGLPAPIEKTISKTKG
QPREPQVYTLPPSREEMTKNQVSLTCLVKGFYPSDIAVEWESNGQPENNYKTTPPML
DSDGSFFLYSKLTVDKSRWQQGNVFSCSVMHEALHNHYTQKSLSLSPGKGGGGSGS
GGGGSNPICKGCLSCSKDNGCSRCQQKLFFFLRREGMRQYGECLHSCPSGYYG
HRAPDMNRCARCRIENCDSCRSKDACTKCKVGFYLHRGRCFDECPDGFAPLEETME
CVE

FIGURE 11AD

LP1-1N15 light chain polynucleotide (SEQ ID NO: 194)

GACATCAAGATGACCCAGTCTCCATCTTCCATGTATGCATCTCTAGGAGAGAGAG
TTACTATCACTTGCAAGGCGAGTCAGGACATTAATAGCCATTTAAGCTGGTTCCA
GCAGAAACCAGGGAAATCTCCTAAGACCCTGATCATTCGTGCAAACAGATTGGT
AGATGGGGTCCCATCAAGGTTCAGTGGCAGTGGATCTGGGCAAGATTATTCTCTC
ACCATCAGCAGCCCGGAGTATGAAGAAATGGGAATTTATTACTGTCTACAGTAT
GATGAGTTTCCGTTCACGTTCGGAGGGGGGACCAAGCTGGAAATAAAACGTACG
GTGGCTGCACCATCTGTCTTCATCTTCCCGCCATCTGATGAGCAGTTGAAATCTG
GAACTGCCTCTGTTGTGTGCCTGCTGAATAACTTCTATCCCAGAGAGGCCAAAGT
ACAGTGGAAGGTGGATAACGCCCTCCAATCGGGTAACTCCCAGGAGAGTGTCAC
AGAGCAGGACAGCAAGGACAGCACCTACAGCCTCAGCAGCACCCTGACGCTGAG
CAAAGCAGACTACGAGAAACACAAAGTCTACGCCTGCGAAGTCACCCATCAGGG
CCTGAGCTCGCCCGTCACAAAGAGCTTCAACAGGGGAGAGTGT

LP1-1N15 light chain polypeptide (SEQ ID NO: 195)

DIKMTQSPSSMYASLGERVTITCKASQDINSHLSWFQQKPGKSPKTLIIRANRLVDGV
PSRFSGSGSGQDYSLTISSPEYEEMGIYYCLQYDEFPFTFGGGTKLEIKRTVAAPSVFIF
PPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

FIGURE 11AE

LP1-1N15 Heavy chain IgG2, RSPO2 (F105R/F109A) polynucleotide (SEQ ID NO: 196)

GAGGTCCAGCTGCAACAGTCTGGACCTGAGCTGGTGAAGCCTGGGGCTTCAGTG
AAGATGTCCTGTAAGGCTTCTGGATACACATTCACTGACTACTACATGAACTGGG
TGAAGCAGAGTCATGGAGAGAGCCTTGAGTGGATTGGACGTGTTATTCCTAGCA
ATGGTGGTACTAACTACAACCAGAAGTTCAAGGGCAAGGCCACATTGACAGTAG
ACAAATCCCTCACCACAGCCTACATGCAGCTCAACAGCCTGACATCTGAAGACTC
TGCGGTCTATTTCTGTGCAAGAGGGATGGACTACTGGGGTCCAGGAACCTCAGTC
ACCGTCTCCAGCGCTAGCACCAAGGGCCCATCGGTCTTCCCCCTGGCGCCCTGCT
CCAGGAGCACCTCCGAGAGCACAGCGGCCCTGGGCTGCCTGGTCAAGGACTACT
TCCCCGAACCGGTGACGGTGTCGTGGAACTCAGGCGCTCTGACCAGCGGCGTGC
ACACCTTCCCAGCTGTCCTACAGTCCTCAGGACTCTACTCCCTCAGCAGCGTGGT
GACCGTGCCCTCCAGCAACTTCGGCACCCAGACCTACACCTGCAACGTAGATCAC
AAGCCCAGCAACACCAAGGTGGACAAGACAGTTGAGCGCAAATGTTGTGTCGAG
TGCCCACCGTGCCCAGCACCACCTGTGGCAGGACCGTCAGTCTTCCTCTTCCCCC
CAAAACCCAAGGACACCCTCATGATCTCCCGGACCCCTGAGGTCACGTGCGTGG
TGGTGGACGTGAGCCACGAAGACCCCGAGGTCCAGTTCAACTGGTACGTGGACG
GCGTGGAGGTGCATAATGCCAAGACAAAGCCACGGGAGGAGCAGTTCAACAGC
ACGTTCCGTGTGGTCAGCGTCCTCACCGTTGTGCACCAGGACTGGCTGAACGGCA
AGGAGTACAAGTGCAAGGTCTCCAACAAAGGCCTCCCAGCCCCCATCGAGAAAA
CCATCTCCAAAACCAAAGGGCAGCCCCGAGAACCACAGGTGTACACCCTGCCCC
CATCCCGGGAGGAGATGACCAAGAACCAGGTCAGCCTGACCTGCCTGGTCAAAG
GCTTCTACCCCAGCGACATCGCCGTGGAGTGGGAGAGCAATGGGCAGCCGGAGA
ACAACTACAAGACCACGCCTCCCATGCTGGACTCCGACGGCTCCTTCTTCCTCTA
CAGCAAGCTCACCGTGGACAAGAGCAGGTGGCAGCAGGGGAACGTCTTCTCATG
CTCCGTGATGCATGAGGCTCTGCACAACCACTACACGCAGAAGAGCCTCTCCCTG
TCTCCGGGTAAAGGTGGTGGTGGCTCGGGATCCGGAGGCTCCGGTGGCGGTGGC
AGCAACCCAATTTGCAAGGGATGCTTAAGCTGTAGCAAGGACAACGGATGTTCA
CGGTGCCAGCAAAAGCTGTTTTTCTTCCTCCGGCGGGAAGGAATGCGGCAGTAC
GGCGAATGTCTCCACTCCTGCCCCTCGGGGTATTACGGACACCGCGCGCCTGACA
TGAACCGATGCGCCAGATGCCGGATCGAGAACTGCGATAGCTGCCGCAGCAAGG
ACGCCTGCACTAAGTGCAAAGTCGGCTTCTACCTTCACCGGGGCAGATGTTTTGA
CGAATGCCCGGATGGCTTCGCCCCGCTGGAGGAGACTATGGAATGCGTGGAG

LP1-1N15 Heavy chain IgG2, RSPO2 (F105R/F109A) polypeptide (SEQ ID NO: 197)

EVQLQQSGPELVKPGASVKMSCKASGYTFTDYYMNWVKQSHGESLEWIGRVIPSNG
GTNYNQKFKGKATLTVDKSLTTAYMQLNSLTSEDSAVYFCARGMDYWGPGTSVTV
SSASTKGPSVFPLAPCSRSTSESTAALGCLVKDYFPEPVTVSWNSGALTSGVHTFPAV
LQSSGLYSLSSVVTVPSSNFGTQTYTCNVDHKPSNTKVDKTVERKCCVECPPCPAPP
VAGPSVFLFPPKPKDTLMISRTPEVTCVVVDVSHEDPEVQFNWYVDGVEVHNAKTK
PREEQFNSTFRVVSVLTVVHQDWLNGKEYKCKVSNKGLPAPIEKTISKTKGQPREPQ
VYTLPPSREEMTKNQVSLTCLVKGFYPSDIAVEWESNGQPENNYKTTPPMLDSDGSF
FLYSKLTVDKSRWQQGNVFSCSVMHEALHNHYTQKSLSLSPGKGGGGSGSGGSGG
GGSNPICKGCLSCSKDNGCSRCQQKLFFFLRREGMRQYGECLHSCPSGYYGHRAPD
MNRCARCRIENCDSCRSKDACTKCKVGFYLHRGRCFDECPDGFAPLEETMECVE

FIGURE 11AF

LP1-1P13 light chain polynucleotide (SEQ ID NO: 198)

GACATCCAGATGACTCAGTCTCCAGCCTCCCTATCTGCATCTGTGGGACAAACTG
TTATCATCACATGTCGAACAAGTGAGAATATTTACAGTAATTTAGCATGGTATCA
GCAGAAACAGGGAAAATCTCCTCAGCTCCTGGTCTATGCTGCAACAAACTTAGC
AGATGGTGTGCCATCAAGGTTCAGTGGCAGTGGTTCAGGCACACAGTATTACCTC
AAGATCAACAGCTGCAGTCTGAAGATTTTGGGAGTTATTACTGTCAACATTTTT
GGGGTAGTACGTGGACGTTCGGTGGAGGCACCAAGCTGGACATCAAACGTACGG
TGGCTGCACCATCTGTCTTCATCTTCCCGCCATCTGATGAGCAGTTGAAATCTGG
AACTGCCTCTGTTGTGTGCCTGCTGAATAACTTCTATCCCAGAGAGGCCAAAGTA
CAGTGGAAGGTGGATAACGCCCTCCAATCGGGTAACTCCAGGAGAGTGTCACA
GAGCAGGACAGCAAGGACAGCACCTACAGCCTCAGCAGCACCCTGACGCTGAGC
AAAGCAGACTACGAGAAACACAAAGTCTACGCCTGCGAAGTCACCCATCAGGGC
CTGAGCTCGCCCGTCACAAAGAGCTTCAACAGGGGAGAGTGT

LP1-1P13 light chain polypeptide (SEQ ID NO: 199)

DIQMTQSPASLSASVGQTVIITCRTSENIYSNLAWYQQKQGKSPQLLVYAATNLADG
VPSRFSGSGSGTQYYLKINSLQSEDFGSYYCQHFWGSTWTFGGGTKLDIK

FIGURE 11AG

LP1-1P13 Heavy chain IgG2, RSPO2 polynucleotide (SEQ ID NO: 200)

GAGGTTCAACTGCAGCAGTCTGGACCTGAACTGGTGAAGCCTGGGGCTTCAGTG
AAGATATCCTGCAAGGCTTCTGGTTACTCATTTACTGACTACTTTATGAACTGGGT
GAAGCAGAGCCATGGAAAGAGCCTTGAGTGGATTGGACGTTTTAATCCTTTCAAT
GGTCAAACTTTCTACAATCAGGAGTTCAAGGGCAAGGCCACATTAACTGTAGAC
AAATCCTCTAGCACCGCCCACATGGAGCTCCGGAGCCTGACATCTGAGGACTCTG
CAGTCTATTATTGTGCAAGAAGAGGAAGGTACGACGTTTACTATGTTCTGGACTA
CTGGGGTCAAGGAACCTCAGTCACCGTCTCCAGCGCTAGCACCAAGGGCCCATC
GGTCTTCCCCCTGGCGCCCTGCTCCAGGAGCACCTCCGAGAGCACAGCGGCCCTG
GGCTGCCTGGTCAAGGACTACTTCCCCGAACCGGTGACGGTGTCGTGGAACTCA
GGCGCTCTGACCAGCGGCGTGCACACCTTCCCAGCTGTCCTACAGTCCTCAGGAC
TCTACTCCCTCAGCAGCGTGGTGACCGTGCCCTCCAGCAACTTCGGCACCCAGAC
CTACACCTGCAACGTAGATCACAAGCCCAGCAACACCAAGGTGGACAAGACAGT
TGAGCGCAAATGTTGTGTCGAGTGCCCACCGTGCCCAGCACCACCTGTGGCAGG
ACCGTCAGTCTTCCTCTTCCCCCCAAAACCCAAGGACACCCTCATGATCTCCCGG
ACCCCTGAGGTCACGTGCGTGGTGGTGGACGTGAGCCACGAAGACCCCGAGGTC
CAGTTCAACTGGTACGTGGACGGCGTGGAGGTGCATAATGCCAAGACAAAGCCA
CGGGAGGAGCAGTTCAACAGCACGTTCCGTGTGGTCAGCGTCCTCACCGTTGTGC
ACCAGGACTGGCTGAACGGCAAGGAGTACAAGTGCAAGGTCTCCAACAAAGGCC
TCCCAGCCCCCATCGAGAAAACCATCTCCAAAACCAAAGGGCAGCCCCGAGAAC
CACAGGTGTACACCCTGCCCCCATCCCGGGAGGAGATGACCAAGAACCAGGTCA
GCCTGACCTGCCTGGTCAAAGGCTTCTACCCCAGCGACATCGCCGTGGAGTGGG
AGAGCAATGGGCAGCCGGAGAACAACTACAAGACCACGCCTCCCATGCTGGACT
CCGACGGCTCCTTCTTCCTCTACAGCAAGCTCACCGTGGACAAGAGCAGGTGGCA
GCAGGGGAACGTCTTCTCATGCTCCGTGATGCATGAGGCTCTGCACAACCACTAC
ACGCAGAAGAGCCTCTCCCTGTCTCCGGGTAAAGGTGGTGGTGGCTCGGGATCC
GGAGGCTCCGGTGGCGGTGGCAGCAACCCAATTTGCAAGGGATGCTTAAGCTGT
AGCAAGGACAACGGATGTTCACGGTGCCAGCAAAAGCTGTTTTTCTTCCTCCGGC
GGGAAGGAATGCGGCAGTACGGCGAATGTCTCCACTCCTGCCCCTCGGGGTATT
ACGGACACCGCGCGCCTGACATGAACCGATGCGCCAGATGCCGGATCGAGAACT
GCGATAGCTGCCGCAGCAAGGACGCCTGCACTAAGTGCAAAGTCGGCTTCTACC
TTCACCGGGGCAGATGTTTTGACGAATGCCCGGATGGCTTCGCCCCGCTGGAGGA
GACTATGGAATGCGTGGAG

LP1-1P13 Heavy chain IgG2, RSPO2 polypeptide (SEQ ID NO: 201)

EVQLQQSGPELVKPGASVKISCKASGYSFTDYFMNWVKQSHGKSLEWIGRFNPFNG
QTFYNQEFKGKATLTVDKSSSTAHMELRSLTSEDSAVYYCARRGRYDVYYVLDYW
GQGTSVTVSSASTKGPSVFPLAPCSRSTSESTAALGCLVKDYFPEPVTVSWNSGALTS
GVHTFPAVLQSSGLYSLSSVVTVPSSNFGTQTYTCNVDHKPSNTKVDKTVERKCCVE
CPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKT
KGQPREPQVYTLPPSREEMTKNQVSLTCLVKGFYPSDIAVEWESNGQPENNYKTTPP
MLDSDGSFFLYSKLTVDKSRWQQGNVFSCSVMHEALHNHYTQKSLSLSPGKGGGGS
GSGGSGGGGSNPICKGCLSCSKDNGCSRCQQKLFFFLRREGMRQYGECLHSCPSGYY
GHRAPDMNRCARCRIENCDSCRSKDACTKCKVGFYLHRGRCFDECPDGFAPLEETM
ECVE

FIGURE 11AH

LP1-1P5 light chain polynucleotide (SEQ ID NO: 202)

GACATTGTGATGACCCAGTCTCAAAAATTCATGTCCACATCAGTAGGAGACAGG
GTCAGCGTCACCTGCAAGGCCAGTCAGAATGTGGGTACTAATGTAGCCTGGTATC
AACAGAAACCAGGACAATCTCCTAAAGCACTGATTTACTCGGCATCTTATCGGTA
CAGTGGAGTCCCTGATCGCTTCACAGGCAGTGGATCTGGGACAGATTTCACTCTC
ACCATCAGCAATGTGCAGTCTGAAGACTTGGCAGAGTATTTCTGTCAACAATATA
ACAGCTATCCGCTCACGTTCGGTGCTGGGACCAAGCTGGAGCTGAAACGTACGG
TGGCTGCACCATCTGTCTTCATCTTCCCGCCATCTGATGAGCAGTTGAAATCTGG
AACTGCCTCTGTTGTGTGCCTGCTGAATAACTTCTATCCCAGAGAGGCCAAAGTA
CAGTGGAAGGTGGATAACGCCCTCCAATCGGGTAACTCCCAGGAGAGTGTCACA
GAGCAGGACAGCAAGGACAGCACCTACAGCCTCAGCAGCACCCTGACGCTGAGC
AAAGCAGACTACGAGAAACACAAAGTCTACGCCTGCGAAGTCACCCATCAGGGC
CTGAGCTCGCCCGTCACAAAGAGCTTCAACAGGGGAGAGTGT

LP1-1P5 light chain polpeptide (SEQ ID NO: 203)

DIVMTQSQKFMSTSVGDRVSVTCKASQNVGTNVAWYQQKPGQSPKALIYSASYRYS
GVPDRFTGSGSGTDFTLTISNVQSEDLAEYFCQQYNSYPLTFGAGTKLELKRTVAAPS
VFIFPPSDEQLKSGTASVVCLLNNFYPREAKVQWKVDNALQSGNSQESVTEQDSKDS
TYSLSSTLTLSKADYEKHKVYACEVTHQGLSSPVTKSFNRGEC

FIGURE 11AI

LP1-1P5 Heavy chain IgG2, RSPO2 (F105R/F109A) polynucleotide (SEQ ID NO: 204)

CAGGTCCAGCTGCAGCAATCTGGACCTGAGCTGGTGAGGCCTGGGACTTCAGTG
AAGATATCCTGCAAGGCTTCTGGCTATACCTTCCTCACCTACTGGATGAACTGGG
TGAAGCAGAGGCCTGGACAGGGCCTTGAGTGGATTGGACAGATTTTCCCTGCAA
CTGGTATTACTTACTACAGTGAGATGTTCAAGGACAAGGCCACATTGACTGAAG
ACACATCCTCCACCACAGCCTACATGCAACTCAGCAGCCTGACATCTGAGGCCAC
TGCTGTCTATTTCTGTGCAAGAAGAAGGGCCTACCATAGTAACTTTTTTGACTACT
GGGGCCAAGGCACCACTCTCACAGTCTCCAGCGCTAGCACCAAGGGCCCATCGG
TCTTCCCCCTGGCGCCCTGCTCCAGGAGCACCTCCGAGAGCACAGCGGCCCTGGG
CTGCCTGGTCAAGGACTACTTCCCCGAACCGGTGACGGTGTCGTGGAACTCAGGC
GCTCTGACCAGCGGCGTGCACACCTTCCCAGCTGTCCTACAGTCCTCAGGACTCT
ACTCCCTCAGCAGCGTGGTGACCGTGCCCTCCAGCAACTTCGGCACCCAGACCTA
CACCTGCAACGTAGATCACAAGCCCAGCAACACCAAGGTGGACAAGACAGTTGA
GCGCAAATGTTGTGTCGAGTGCCCACCGTGCCCAGCACCACCTGTGGCAGGACC
GTCAGTCTTCCTCTTCCCCCCAAAACCCAAGGACACCCTCATGATCTCCCGGACC
CCTGAGGTCACGTGCGTGGTGGTGGACGTGAGCCACGAAGACCCCGAGGTCCAG
TTCAACTGGTACGTGGACGGCGTGGAGGTGCATAATGCCAAGACAAAGCCACGG
GAGGAGCAGTTCAACAGCACGTTCCGTGTGGTCAGCGTCCTCACCGTTGTGCACC
AGGACTGGCTGAACGGCAAGGAGTACAAGTGCAAGGTCTCCAACAAAGGCCTCC
CAGCCCCCATCGAGAAAACCATCTCCAAAACCAAAGGGCAGCCCCGAGAACCAC
AGGTGTACACCTGCCCCCATCCCGGGAGGAGATGACCAAGAACCAGGTCAGCC
TGACCTGCCTGGTCAAAGGCTTCTACCCCAGCGACATCGCCGTGGAGTGGGAGA
GCAATGGGCAGCCGGAGAACAACTACAAGACCACGCCTCCCATGCTGGACTCCG
ACGGCTCCTTCTTCCTCTACAGCAAGCTCACCGTGGACAAGAGCAGGTGGCAGC
AGGGGAACGTCTTCTCATGCTCCGTGATGCATGAGGCTCTGCACAACCACTACAC
GCAGAAGAGCCTCTCCCTGTCTCCGGGTAAAGGTGGTGGTGGCTCGGGATCCGG
AGGCTCCGGTGGCGGTGGCAGCAACCCAATTTGCAAGGGATGCTTAAGCTGTAG
CAAGGACAACGGATGTTCACGGTGCCAGCAAAAGCTGTTTTTCTTCCTCCGGCGG
GAAGGAATGCGGCAGTACGGCGAATGTCTCCACTCCTGCCCCTCGGGGTATTAC
GGACACCGCGCGCCTGACATGAACCGATGCGCCAGATGCCGGATCGAGAACTGC
GATAGCTGCCGCAGCAAGGACGCCTGCACTAAGTGCAAAGTCGGCTTCTACCTTC
ACCGGGGCAGATGTTTTGACGAATGCCCGGATGGCTTCGCCCCGCTGGAGGAGA
CTATGGAATGCGTGGAG

LP1-1P5 Heavy chain IgG2, RSPO2 (F105R/F109A) polypeptide (SEQ ID NO: 205)

QVQLQQSGPELVRPGTSVKISCKASGYTFLTYWMNWVKQRPGQGLEWIGQIFPATGI
TYYSEMFKDKATLTEDTSSTTAYMQLSSLTSEATAVYFCARRRAYHSNFFDYWGQG
TTLTVSSASTKGPSVFPLAPCSRSTSESTAALGCLVKDYFPEPVTVSWNSGALTSGVH
TFPAVLQSSGLYSLSSVVTVPSSNFGTQTYTCNVDHKPSNTKVDKTVERKCCVECPP
CPAPPVAGPSVFLFPPKPKDTLMISRTPEVTCVVVDVSHEDPEVQFNWYVDGVEVHN
AKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDS
DGSFFLYSKLTVDKSRWQQGNVFSCSVMHEALHNHYTQKSLSLSPGKGGGGSGSGG
SGGGGSNPICKGCLSCSKDNGCSRCQQKLFFFLRREGMRQYGECLHSCPSGYYGHR
APDMNRCARCRIENCDSCRSKDACTKCKVGFYLHRGRCFDECPDGFAPLEETMECV
E

FIGURE 11AJ

LP1-2E12 light chain polynucleotide (SEQ ID NO: 206)

GATGTTGTGGTGACTCAAACTCCACTCTCCCTGCCTGTCAGCTTTGGAGATCGAG
TTTCTATCTCTTGCAGGTCTAGTCAGAGTCTTGCAAACAGTTATGGGAACACCTA
TTTGTCTTGGTACCTGCACAAGCCTGGCCAGTCTCCACAGCTCCTCATCTATGGG
ATTTCCAACAGATTTTCTGGGGTGCCAGACAGGTTCAGTGGCAGTGGTTCAGGGA
CAGATTTCACACTCAAGATCAGCACAATAAAGCCTGAGGACTTGGGAATGTATT
ACTGCTTACAAGGTACACATCAGCCTCTCACGTTCGGTGCTGGGACCAAGCTGGA
GCTGAAACGTACGGTGGCTGCACCATCTGTCTTCATCTTCCCGCCATCTGATGAG
CAGTTGAAATCTGGAACTGCCTCTGTTGTGTGCCTGCTGAATAACTTCTATCCCA
GAGAGGCCAAAGTACAGTGGAAGGTGGATAACGCCCTCCAATCGGGTAACTCCC
AGGAGAGTGTCACAGAGCAGGACAGCAAGGACAGCACCTACAGCCTCAGCAGC
ACCCTGACGCTGAGCAAAGCAGACTACGAGAAACACAAAGTCTACGCCTGCGAA
GTCACCCATCAGGGCCTGAGCTCGCCCGTCACAAAGAGCTTCAACAGGGGAGAG
TGT

LP1-2E12 light chain polypeptide (SEQ ID NO: 207)

DVVVTQTPLSLPVSFGDRVSISCRSSQSLANSYGNTYLSWYLHKPGQSPQLLIYGISN
RFSGVPDRFSGSGSGTDFTLKISTIKPEDLGMYYCLQGTHQPLTFGAGTKLELKRTVA
APSVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC

FIG. 11AK

LP1-2E12 Heavy chain IgG2, RSPO2 (F105R/F109A) polynucleotide (SEQ ID NO: 208)

GATGTACAACTTCAGGAGTCAGGACCTGGCCTCGTGAAACCTTCTCAGTCTCTGT
CTCTCACCTGCTCTGTCACTGGCTACTCCATCACCAGTGGTTATTACTGGAACTGG
ATCCGGCAGTTTCCAGGAAACAAACTGGAATGGATGGGCTCCATAGGCTACGAT
GATACCAATCACTACAACCCATCTCTCAAAAATCGAATCTCCATCACTCGTGACA
CATCTAAGAACCAGTTTTTCCTGAAGTTGAATTCTGTGACAACTGAGGACACAGC
CACATATTACTGTGCAGGTGACTACCCCTTTGCTTTCTGGGGCCAAGGGACTCTG
GTCACTGTCTCTGCAGCTAGCACCAAGGGCCCATCGGTCTTCCCCCTGGCGCCCT
GCTCCAGGAGCACCTCCGAGAGCACAGCGGCCCTGGGCTGCCTGGTCAAGGACT
ACTTCCCCGAACCGGTGACGGTGTCGTGGAACTCAGGCGCTCTGACCAGCGGCG
TGCACACCTTCCCAGCTGTCCTACAGTCCTCAGGACTCTACTCCCTCAGCAGCGT
GGTGACCGTGCCCTCCAGCAACTTCGGCACCCAGACCTACACCTGCAACGTAGAT
CACAAGCCCAGCAACACCAAGGTGGACAAGACAGTTGAGCGCAAATGTTGTGTC
GAGTGCCCACCGTGCCCAGCACCACCTGTGGCAGGACCGTCAGTCTTCCTCTTCC
CCCCAAAACCCAAGGACACCCTCATGATCTCCCGGACCCCTGAGGTCACGTGCGT
GGTGGTGGACGTGAGCCACGAAGACCCCGAGGTCCAGTTCAACTGGTACGTGGA
CGGCGTGGAGGTGCATAATGCCAAGACAAAGCCACGGGAGGAGCAGTTCAACA
GCACGTTCCGTGTGGTCAGCGTCCTCACCGTTGTGCACCAGGACTGGCTGAACGG
CAAGGAGTACAAGTGCAAGGTCTCCAACAAAGGCCTCCCAGCCCCCATCGAGAA
AACCATCTCCAAAACCAAAGGGCAGCCCCGAGAACCACAGGTGTACACCCTGCC
CCCATCCCGGGAGGAGATGACCAAGAACCAGGTCAGCCTGACCTGCCTGGTCAA
AGGCTTCTACCCCAGCGACATCGCCGTGGAGTGGGAGAGCAATGGGCAGCCGGA
GAACAACTACAAGACCACGCCTCCCATGCTGGACTCCGACGGCTCCTTCTTCCTC
TACAGCAAGCTCACCGTGGACAAGAGCAGGTGGCAGCAGGGGAACGTCTTCTCA
TGCTCCGTGATGCATGAGGCTCTGCACAACCACTACACGCAGAAGAGCCTCTCCC
TGTCTCCGGGTAAAGGTGGTGGTGGCTCGGGATCCGGAGGCTCCGGTGGCGGTG
GCAGCAACCCAATTTGCAAGGGATGCTTAAGCTGTAGCAAGGACAACGGATGTT
CACGGTGCCAGCAAAAGCTGTTTTTCTTCCTCCGGCGGGAAGGAATGCGGCAGT
ACGGCGAATGTCTCCACTCCTGCCCCTCGGGGTATTACGGACACCGCGCGCCTGA
CATGAACCGATGCGCCAGATGCCGGATCGAGAACTGCGATAGCTGCCGCAGCAA
GGACGCCTGCACTAAGTGCAAAGTCGGCTTCTACCTTCACCGGGGCAGATGTTTT
GACGAATGCCCGGATGGCTTCGCCCCGCTGGAGGAGACTATGGAATGCGTGGAG

LP1-2E12 Heavy chain IgG2, RSPO2 (F105R/F109A) polypeptide (SEQ ID NO: 209)

DVQLQESGPGLVKPSQSLSLTCSVTGYSITSGYYWNWIRQFPGNKLEWMGSIGYDDT
NHYNPSLKNRISITRDTSKNQFFLKLNSVTTEDTATYYCAGDYPFAFWGQGTLVTVS
AASTKGPSVFPLAPCSRSTSESTAALGCLVKDYFPEPVTVSWNSGALTSGVHTFPAVL
QSSGLYSLSSVVTVPSSNFGTQTYTCNVDHKPSNTKVDKTVERKCCVECPPCPAPPV
AGPSVFLFPPKPKDTLMISRTPEVTCVVVDVSHEDPEVQFNWYVDGVEVHNAKTKP
REEQFNSTFRVVSVLTVVHQDWLNGKEYKCKVSNKGLPAPIEKTISKTKGQPREPQV
YTLPPSREEMTKNQVSLTCLVKGFYPSDIAVEWESNGQPENNYKTTPPMLDSDGSFF
LYSKLTVDKSRWQQGNVFSCSVMHEALHNHYTQKSLSLSPGKGGGGSGSGGSGGG
GSNPICKGCLSCSKDNGCSRCQQKLFFFLRREGMRQYGECLHSCPSGYYGHRAPDM
NRCARCRIENCDSCRSKDACTKCKVGFYLHRGRCFDECPDGFAPLEETMECVE

FIG. 11AL

LP1-2113 light chain polynucleotide (SEQ ID NO: 210)

GACATCCAGATGACTCAGTCTCCAGCCTCCCTATCTGCATCTGTGGGAGAAACTG
TCACCATCACATGTCGAGCAAGTGAGAATATTTACAGTTATTTAGTATGGTATCA
GCAGAAACAGGGAAAATCTCCTCAGCTCCTGGTCTATAATGCAAAAACCTTAGC
AGAAGGTGTGCCATCAAGGTTCAGTGGCAGTGGATCAGGCACACAGTTTTCTCTG
AAGATCAACAGCCTGCAGCCTGAAGATTTTGGGAGTTATTACTGTCAACATCATT
ATGGTACTTGGACGTTCGGTGGAGGCATAAAGCTGGAAATCAAACGTACGGTGG
CTGCACCATCTGTCTTCATCTTCCCGCCATCTGATGAGCAGTTGAAATCTGGAAC
TGCCTCTGTTGTGTGCCTGCTGAATAACTTCTATCCCAGAGAGGCCAAAGTACAG
TGGAAGGTGGATAACGCCCTCCAATCGGGTAACTCCCAGGAGAGTGTCACAGAG
CAGGACAGCAAGGACAGCACCTACAGCCTCAGCAGCACCCTGACGCTGAGCAAA
GCAGACTACGAGAAACACAAAGTCTACGCCTGCGAAGTCACCCATCAGGGCCTG
AGCTCGCCCGTCACAAAGAGCTTCAACAGGGGAGAGTGT

LP1-2113 light chain polypeptide (SEQ ID NO: 211)

DIQMTQSPASLSASVGETVTITCRASENIYSYLVWYQQKQGKSPQLLVYNAKTLAEG
VPSRFSGSGSGTQFSLKINSLQPEDFGSYYCQHHYGTWTFGGGIKLEIKRTVAAPSVFI
FPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC

FIG. 11AM

LP1-2I13 Heavy chain IgG2, RSPO2 (F105R/F109A) polynucleotide (SEQ ID NO: 212)

GAGGTGCAGCTGGTGGAGTCTGGGGGAGGCTTAGTGAAGCCTGGAGGGTCCCGG
AAACTCTCCTGTGCAGCCTCTGGATTCACTTTCAGTGACTATGGAATGCACTGGG
TCCGTCAGGCTCCAGAGAAGGGGCTGGAGTGGGTTGCCTACATTAGTAGTGGCA
GTAGTACCATCTACTATGCAGACACAGTGAAGGGCCGATTCACCATCTCCAGAG
ACAATGCCAAGAACACCCTGTTCCTACAAATGACCAGTCTAAGGTCTGAGGACA
CAGCCATGTATTACTGTTCAAGGAAGGGAGGGTTTGGTGACTACGAGAAAAGCT
ATGCTATGGACTACTGGGGTCAAGGAACCTCAGTCACCGTCTCCAGCGCTAGCAC
CAAGGGCCCATCGGTCTTCCCCCTGGCGCCCTGCTCCAGGAGCACCTCCGAGAGC
ACAGCGGCCCTGGGCTGCCTGGTCAAGGACTACTTCCCCGAACCGGTGACGGTG
TCGTGGAACTCAGGCGCTCTGACCAGCGGCGTGCACACCTTCCCAGCTGTCCTAC
AGTCCTCAGGACTCTACTCCCTCAGCAGCGTGGTGACCGTGCCCTCCAGCAACTT
CGGCACCCAGACCTACACCTGCAACGTAGATCACAAGCCCAGCAACACCAAGGT
GGACAAGACAGTTGAGCGCAAATGTTGTGTCGAGTGCCCACCGTGCCCAGCACC
ACCTGTGGCAGGACCGTCAGTCTTCCTCTTCCCCCCAAAACCCAAGGACACCCTC
ATGATCTCCCGGACCCCTGAGGTCACGTGCGTGGTGGTGGACGTGAGCCACGAA
GACCCCGAGGTCCAGTTCAACTGGTACGTGGACGGCGTGGAGGTGCATAATGCC
AAGACAAAGCCACGGGAGGAGCAGTTCAACAGCACGTTCCGTGTGGTCAGCGTC
CTCACCGTTGTGCACCAGGACTGGCTGAACGGCAAGGAGTACAAGTGCAAGGTC
TCCAACAAAGGCCTCCCAGCCCCCATCGAGAAAACCATCTCCAAAACCAAAGGG
CAGCCCCGAGAACCACAGGTGTACACCCTGCCCCCATCCCGGGAGGAGATGACC
AAGAACCAGGTCAGCCTGACCTGCCTGGTCAAAGGCTTCTACCCCAGCGACATC
GCCGTGGAGTGGGAGAGCAATGGGCAGCCGGAGAACAACTACAAGACCACGCC
TCCCATGCTGGACTCCGACGGCTCCTTCTTCCTCTACAGCAAGCTCACCGTGGAC
AAGAGCAGGTGGCAGCAGGGGAACGTCTTCTCATGCTCCGTGATGCATGAGGCT
CTGCACAACCACTACACGCAGAAGAGCCTCTCCCTGTCTCCGGGTAAAGGTGGT
GGTGGCTCGGGATCCGGAGGCTCCGGTGGCGGTGGCAGCAACCCAATTTGCAAG
GGATGCTTAAGCTGTAGCAAGGACAACGGATGTTCACGGTGCCAGCAAAAGCTG
TTTTTCTTCCTCCGGCGGGAAGGAATGCGGCAGTACGGCGAATGTCTCCACTCCT
GCCCCTCGGGGTATTACGGACACCGCGCGCCTGACATGAACCGATGCGCCAGAT
GCCGGATCGAGAACTGCGATAGCTGCCGCAGCAAGGACGCCTGCACTAAGTGCA
AAGTCGGCTTCTACCTTCACCGGGGCAGATGTTTTGACGAATGCCCGGATGGCTT
CGCCCCGCTGGAGGAGACTATGGAATGCGTGGAG

LP1-2I13 Heavy chain IgG2, RSPO2 (F105R/F109A) polypeptide (SEQ ID NO: 213)

EVQLVESGGGLVKPGGSRKLSCAASGFTFSDYGMHWVRQAPEKGLEWVAYISSGSS
TIYYADTVKGRFTISRDNAKNTLFLQMTSLRSEDTAMYYCSRKGGFGDYEKSYAMD
YWGQGTSVTVSSASTKGPSVFPLAPCSRSTSESTAALGCLVKDYFPEPVTVSWNSGA
LTSGVHTFPAVLQSSGLYSLSSVVTVPSSNFGTQTYTCNVDHKPSNTKVDKTVERKC
CVECPPCPAPPVAGPSVFLFPPKPKDTLMISRTPEVTCVVVDVSHEDPEVQFNWYVD
GVEVHNAKTKPREEQFNSTFRVVSVLTVVHQDWLNGKEYKCKVSNKGLPAPIEKTI
SKTKGQPREPQVYTLPPSREEMTKNQVSLTCLVKGFYPSDIAVEWESNGQPENNYKT
TPPMLDSDGSFFLYSKLTVDKSRWQQGNVFSCSVMHEALHNHYTQKSLSLSPGKGG
GGSGSGGSGGGGSNPICKGCLSCSKDNGCSRCQQKLFFFLRREGMRQYGECLHSCPS
GYYGHRAPDMNRCARCRIENCDSCRSKDACTKCKVGFYLHRGRCFDECPDGFAPLE
ETMECVE

LP1-2I22 light chain polynucleotide (SEQ ID NO: 214)

GACATCCAGATGACTCAGTCTCCAGCCTCCCTATCTGCATCTGTGGGAGAAACTG
TTATCATCACATGTCGAGCAAGTGAGAATATTTACAGTAATTTAGCATGGTATCA
GCAGAAACAGGGAAAATCTCCTCAGCTCCTGGTCTATGGTGCAACAAACTTAGC
AGATGGTGTGACATCAAGGTTCAGTGGCAGTGGTTCAGGCACACAGTTTTCCCTC
AAGATCGACAGCCTGCAGTCTGAAGATTTTGGGAGTTATTACTGTCAACATTTTT
GGGGTACTACGTGGACGTTCGGTGGAGGCACCAAGCTGGAAATCAAACGTACGG
TGGCTGCACCATCTGTCTTCATCTTCCCGCCATCTGATGAGCAGTTGAAATCTGG
AACTGCCTCTGTTGTGTGCCTGCTGAATAACTTCTATCCAGAGAGGCCAAAGTA
CAGTGGAAGGTGGATAACGCCCTCCAATCGGGTAACTCCCAGGAGAGTGTCACA
GAGCAGGACAGCAAGGACAGCACCTACAGCCTCAGCAGCACCCTGACGCTGAGC
AAAGCAGACTACGAGAAACACAAAGTCTACGCCTGCGAAGTCACCCATCAGGGC
CTGAGCTCGCCCGTCACAAAGAGCTTCAACAGGGGAGAGTGT

LP1-2I22 light chain polypeptide (SEQ ID NO: 215)

DIQMTQSPASLSASVGETVIITCRASENIYSNLAWYQQKQGKSPQLLVYGATNLADG
VTSRFSGSGSGTQFSLKIDSLQSEDFGSYYCQHFWGTTWTFGGGTKLEIKRTVAAPSV
FIFPPSDEQLKSGTASVVCLLNNFYPREAKVQWKVDNALQSGNSQESVTEQDSKDST
YSLSSTLTLSKADYEKHKVYACEVTHQGLSSPVTKSFNRGEC

FIG. 11AO

LP1-2I22 Heavy chain IgG2, RSPO2 (F105R/F109A) polynucleotide (SEQ ID NO: 216)

GAGGTTCAACTGCAGCAGTCTGGACCTGAACTGGTGAAGCCTGGGGCTTCAGTG
AAGATATCCTGCAAGGCTTCTGGTTACTCATTTACTGGCTACTTTATGAACTGGGT
GAAGCAGAGCCATGGAAAGAGCCTTGAGTGGATTGGACGTTTTAATCCTTTCAAT
GGTCAAACTTTCTACAATCAGGAGTTCAAGGGCAAGGCCACATTAACTGTTGAC
AAATCCTCTGACACCGCCCACATGGAACTCCGGAGCCTGACATCTGAGGACTCTG
CAGTCTATTATTGTGCAAGAAGAGGAAGGTACGACGTTTACTATGCTCTGGACTA
CTGGGGTCAAGGAACCTCAGTCACCGTCTCCAGCGCTAGCACCAAGGGCCCATC
GGTCTTCCCCCTGGCGCCCTGCTCCAGGAGCACCTCCGAGAGCACAGCGGCCCTG
GGCTGCCTGGTCAAGGACTACTTCCCCGAACCGGTGACGGTGTCGTGGAACTCA
GGCGCTCTGACCAGCGGCGTGCACACCTTCCCAGCTGTCCTACAGTCCTCAGGAC
TCTACTCCCTCAGCAGCGTGGTGACCGTGCCCTCCAGCAACTTCGGCACCCAGAC
CTACACCTGCAACGTAGATCACAAGCCCAGCAACACCAAGGTGGACAAGACAGT
TGAGCGCAAATGTTGTGTCGAGTGCCCACCGTGCCCAGCACCACCTGTGGCAGG
ACCGTCAGTCTTCCTCTTCCCCCCAAAACCCAAGGACACCCTCATGATCTCCCGG
ACCCCTGAGGTCACGTGCGTGGTGGTGGACGTGAGCCACGAAGACCCCGAGGTC
CAGTTCAACTGGTACGTGGACGGCGTGGAGGTGCATAATGCCAAGACAAAGCCA
CGGGAGGAGCAGTTCAACAGCACGTTCCGTGTGGTCAGCGTCCTCACCGTTGTGC
ACCAGGACTGGCTGAACGGCAAGGAGTACAAGTGCAAGGTCTCCAACAAAGGCC
TCCCAGCCCCCATCGAGAAAACCATCTCCAAAACCAAAGGGCAGCCCCGAGAAC
CACAGGTGTACACCCTGCCCCCATCCCGGGAGGAGATGACCAAGAACCAGGTCA
GCCTGACCTGCCTGGTCAAAGGCTTCTACCCCAGCGACATCGCCGTGGAGTGGG
AGAGCAATGGGCAGCCGGAGAACAACTACAAGACCACGCCTCCCATGCTGGACT
CCGACGGCTCCTTCTTCCTCTACAGCAAGCTCACCGTGGACAAGAGCAGGTGGCA
GCAGGGGAACGTCTTCTCATGCTCCGTGATGCATGAGGCTCTGCACAACCACTAC
ACGCAGAAGAGCCTCTCCCTGTCTCCGGGTAAAGGTGGTGGTGGCTCGGGATCC
GGAGGCTCCGGTGGCGGTGGCAGCAACCCAATTTGCAAGGGATGCTTAAGCTGT
AGCAAGGACAACGGATGTTCACGGTGCCAGCAAAAGCTGTTTTTCTTCCTCCGGC
GGGAAGGAATGCGGCAGTACGGCGAATGTCTCCACTCCTGCCCCTCGGGGTATT
ACGGACACCGCGCCTGACATGAACCGATGCGCCAGATGCCGGATCGAGAACT
GCGATAGCTGCCGCAGCAAGGACGCCTGCACTAAGTGCAAAGTCGGCTTCTACC
TTCACCGGGGCAGATGTTTTGACGAATGCCCGGATGGCTTCGCCCCGCTGGAGGA
GACTATGGAATGCGTGGAG

LP1-2I22 Heavy chain IgG2, RSPO2 (F105R/F109A) polypeptide (SEQ ID NO: 217)

EVQLQQSGPELVKPGASVKISCKASGYSFTGYFMNWVKQSHGKSLEWIGRFNPFNG
QTFYNQEFKGKATLTVDKSSDTAHMELRSLTSEDSAVYYCARRGRYDVYYALDYW
GQGTSVTVSSASTKGPSVFPLAPCSRSTSESTAALGCLVKDYFPEPVTVSWNSGALTS
GVHTFPAVLQSSGLYSLSSVVTVPSSNFGTQTYTCNVDHKPSNTKVDKTVERKCCVE
CPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKT
KGQPREPQVYTLPPSREEMTKNQVSLTCLVKGFYPSDIAVEWESNGQPENNYKTTPP
MLDSDGSFFLYSKLTVDKSRWQQGNVFSCSVMHEALHNHYTQKSLSLSPGKGGGGS
GSGGSGGGGSNPICKGCLSCSKDNGCSRCQQKLFFFLRREGMRQYGECLHSCPSGYY
GHRAPDMNRCARCRIENCDSCRSKDACTKCKVGFYLHRGRCFDECPDGFAPLEETM
ECVE

LP1-3A24 light chain polynucleotide (SEQ ID NO: 218)

GACATTGTGATGACCCAGTCTCAAAAATTCATGTCCACATCAGTAGGAGACAGG
GTCAGCGTCACCTGCAAGGCCAGTCAGAATGTGGGTAGTAATGTAGCCTGGTTTC
AACAGAAACCAGGGCAATCTCCTAAAGCACTGATTTACTCGTCATCCTACCGGTA
CAGTGGAGTCCCTGATCGCTTCACGGGCAGTGGATCTGGGACAGATTTCACTCTC
ACCATCACCAATGTGCAGTCTGAAGACTTGGCAGAGTATTTCTGTCAGCAATATA
ACAGCTTTCCTCTCACGTTCGGTGCTGGGACCAAGCTGGAACTGAAACGTACGGT
GGCTGCACCATCTGTCTTCATCTTCCCGCCATCTGATGAGCAGTTGAAATCTGGA
ACTGCCTCTGTTGTGTGCCTGCTGAATAACTTCTATCCCAGAGAGGCCAAAGTAC
AGTGGAAGGTGGATAACGCCCTCCAATCGGGTAACTCCCAGGAGAGTGTCACAG
AGCAGGACAGCAAGGACAGCACCTACAGCCTCAGCAGCACCCTGACGCTGAGCA
AAGCAGACTACGAGAAACACAAAGTCTACGCCTGCGAAGTCACCCATCAGGGCC
TGAGCTCGCCCGTCACAAAGAGCTTCAACAGGGGAGAGTGT

LP1-3A24 light chain polypeptide (SEQ ID NO: 219)

DIVMTQSQKFMSTSVGDRVSVTCKASQNVGSNVAWFQQKPGQSPKALIYSSSYRYS
GVPDRFTGSGSGTDFTLTITNVQSEDLAEYFCQQYNSFPLTFGAGTKLELKRTVAAPS
VFIFPPSDEQLKSGTASVVCLLNNFYPREAKVQWKVDNALQSGNSQESVTEQDSKDS
TYSLSSTLTLSKADYEKHKVYACEVTHQGLSSPVTKSFNRGEC

FIG. 11AQ

LP1-3A24 Heavy chain IgG2, RSPO2 (F105R/F109A) polynucleotide (SEQ ID NO: 220)

GAGGTCCAGCTGCAACAGTCTGGACCTGAGCTGGTGAAGCCTGGGGCTTCAGTG
AAGATGTCCTGTAAGGCTTCTGGATACACATTCACTGACTACTACATAAACTGGG
TGAGGCAGAGTCATGGAAAGAGCCTTGAGTGGATTGGACGTGTTATTCCTAGCA
ATGGTGGTAGTAACTACAACCAGAAGTTCAAGGGCAAGGCCACATTGACAGTAG
ACAAATCCCTCAGTACAGCCTACATGCACCTCAACAGCCTGACATCTGAGGACTC
TGCGGTCTATTACTGTGCAACCCAGCTGGGACGGTGGGGCCAAGGGACTCTGGT
CACTGTCTCTGCAGCTAGCACCAAGGGCCCATCGGTCTTCCCCCTGGCGCCCTGC
TCCAGGAGCACCTCCGAGAGCACAGCGGCCCTGGGCTGCCTGGTCAAGGACTAC
TTCCCCGAACCGGTGACGGTGTCGTGGAACTCAGGCGCTCTGACCAGCGGCGTG
CACACCTTCCCAGCTGTCCTACAGTCCTCAGGACTCTACTCCCTCAGCAGCGTGG
TGACCGTGCCCTCCAGCAACTTCGGCACCCAGACCTACACCTGCAACGTAGATCA
CAAGCCCAGCAACACCAAGGTGGACAAGACAGTTGAGCGCAAATGTTGTGTCGA
GTGCCCACCGTGCCCAGCACCACCTGTGGCAGGACCGTCAGTCTTCCTCTTCCCC
CCAAAACCCAAGGACACCCTCATGATCTCCCGGACCCCTGAGGTCACGTGCGTG
GTGGTGGACGTGAGCCACGAAGACCCCGAGGTCCAGTTCAACTGGTACGTGGAC
GGCGTGGAGGTGCATAATGCCAAGACAAAGCCACGGGAGGAGCAGTTCAACAG
CACGTTCCGTGTGGTCAGCGTCCTCACCGTTGTGCACCAGGACTGGCTGAACGGC
AAGGAGTACAAGTGCAAGGTCTCCAACAAAGGCCTCCCAGCCCCCATCGAGAAA
ACCATCTCCAAAACCAAAGGGCAGCCCCGAGAACCACAGGTGTACACCCTGCCC
CCATCCCGGGAGGAGATGACCAAGAACCAGGTCAGCCTGACCTGCCTGGTCAAA
GGCTTCTACCCCAGCGACATCGCCGTGGAGTGGGAGAGCAATGGGCAGCCGGAG
AACAACTACAAGACCACGCCTCCCATGCTGGACTCCGACGGCTCCTTCTTCCTCT
ACAGCAAGCTCACCGTGGACAAGAGCAGGTGGCAGCAGGGGAACGTCTTCTCAT
GCTCCGTGATGCATGAGGCTCTGCACAACCACTACACGCAGAAGAGCCTCTCCCT
GTCTCCGGGTAAAGGTGGTGGTGGCTCGGGATCCGGAGGCTCCGGTGGCGGTGG
CAGCAACCCAATTTGCAAGGGATGCTTAAGCTGTAGCAAGGACAACGGATGTTC
ACGGTGCCAGCAAAAGCTGTTTTTCTTCCTCCGGCGGGAAGGAATGCGGCAGTA
CGGCGAATGTCTCCACTCCTGCCCCTCGGGGTATTACGGACACCGCGCGCCTGAC
ATGAACCGATGCGCCAGATGCCGGATCGAGAACTGCGATAGCTGCCGCAGCAAG
GACGCCTGCACTAAGTGCAAAGTCGGCTTCTACCTTCACCGGGGCAGATGTTTTG
ACGAATGCCCGGATGGCTTCGCCCCGCTGGAGGAGACTATGGAATGCGTGGAG

LP1-3A24 Heavy chain IgG2, RSPO2 (F105R/F109A) polypeptide (SEQ ID NO: 221)

EVQLQQSGPELVKPGASVKMSCKASGYTFTDYYINWVRQSHGKSLEWIGRVIPSNG
GSNYNQKFKGKATLTVDKSLSTAYMHLNSLTSEDSAVYYCATQLGRWGQGTLVTV
SAASTKGPSVFPLAPCSRSTSESTAALGCLVKDYFPEPVTVSWNSGALTSGVHTFPAV
LQSSGLYSLSSVVTVPSSNFGTQTYTCNVDHKPSNTKVDKTVERKCCVECPPCPAPP
VAGPSVFLFPPKPKDTLMISRTPEVTCVVVDVSHEDPEVQFNWYVDGVEVHNAKTK
PREEQFNSTFRVVSVLTVVHQDWLNGKEYKCKVSNKGLPAPIEKTISKTKGQPREPQ
VYTLPPSREEMTKNQVSLTCLVKGFYPSDIAVEWESNGQPENNYKTTPPMLDSDGSF
FLYSKLTVDKSRWQQGNVFSCSVMHEALHNHYTQKSLSLSPGKGGGGSGSGGSGG
GGSNPICKGCLSCSKDNGCSRCQQKLFFFLRREGMRQYGECLHSCPSGYYGHRAPD
MNRCARCRIENCDSCRSKDACTKCKVGFYLHRGRCFDECPDGFAPLEETMECVE

FIG. 11AR

LP1-3E20 light chain polynucleotide (SEQ ID NO: 222)

GACATCAAGATGACCCAGTCTCCATCTTCCATGTATGCATCTCTAGGAGAGAGAG
TCACTATCACTTGCAAGGCGAGTCAGGACATTAATAGCTATTTAAGCTGGTTCCA
GCAGAAACCAGGGAAATCTCCTAAGACCCTGATCTATCGTGCAAACAGATTGGT
AGATGGGGTCCCATCAAGGTTCAGTGGCAGTGGATCTGGGCAAGATTATTCTCTC
ACCATCAGCAGCCTAGAGTATGAAGATATGGGAATTTATTATTGTCTACAGTATG
ATGACTTGTGGACGTTCGGTGGAGGCACCAAGCTGGAAATCAAACGTACGGTGG
CTGCACCATCTGTCTTCATCTTCCCGCCATCTGATGAGCAGTTGAAATCTGGAAC
TGCCTCTGTTGTGTGCCTGCTGAATAACTTCTATCCCAGAGAGGCCAAAGTACAG
TGGAAGGTGGATAACGCCCTCCAATCGGGTAACTCCCAGGAGAGTGTCACAGAG
CAGGACAGCAAGGACAGCACCTACAGCCTCAGCAGCACCCTGACGCTGAGCAAA
GCAGACTACGAGAAACACAAAGTCTACGCCTGCGAAGTCACCCATCAGGGCCTG
AGCTCGCCCGTCACAAAGAGCTTCAACAGGGGAGAGTGT

LP1-3E20 light chain polypeptide (SEQ ID NO: 223)

DIKMTQSPSSMYASLGERVTITCKASQDINSYLSWFQQKPGKSPKTLIYRANRLVDG
VPSRFSGSGSGQDYSLTISSLEYEDMGIYYCLQYDDLWTFGGGTKLEIKRTVAAPSVF
IFPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC

FIG. 11AS

LP1-3E20 Heavy chain IgG2, RSPO2 (F105R/F109A) polynucleotide (SEQ ID NO: 224)

CAGGTCCAACTGCAGCAGTCTGGGGCTGAACTGGCAAAACCTGGGGCCTCAGTG
AAGATGTCCTGCAAGGCTTCTGGCTACACCTTTACTAGCTACTGGATACACTGGG
TAAAACAGAGGCCTGGACAGGGTCTGGAATGGATTGGATACATTAATCCTAGCA
GTGGTTATGCTGAGTACAATCAGAAGTTCAAGGTCAGGGCCACATTGACTGCAG
ACAAATCCTCCAGCACAGCCTACATGCAACTAAGCAGCCTGACATCTGAGGACT
CTGCAGTCTATTACTGTGCAAGAGAAAGTTACTATAGTTTCGACTATACTATGGA
CTACTGGGGTCAAGGAACCTCAGTCACCGTCTCCAGCGCTAGCACCAAGGGCCC
ATCGGTCTTCCCCCTGGCGCCCTGCTCCAGGAGCACCTCCGAGAGCACAGCGGCC
CTGGGCTGCCTGGTCAAGGACTACTTCCCCGAACCGGTGACGGTGTCGTGGAACT
CAGGCGCTCTGACCAGCGGCGTGCACACCTTCCCAGCTGTCCTACAGTCCTCAGG
ACTCTACTCCCTCAGCAGCGTGGTGACCGTGCCCTCCAGCAACTTCGGCACCCAG
ACCTACACCTGCAACGTAGATCACAAGCCCAGCAACACCAAGGTGGACAAGACA
GTTGAGCGCAAATGTTGTGTCGAGTGCCCACCGTGCCCAGCACCACCTGTGGCAG
GACCGTCAGTCTTCCTCTTCCCCCCAAAACCCAAGGACACCCTCATGATCTCCCG
GACCCCTGAGGTCACGTGCGTGGTGGTGGACGTGAGCCACGAAGACCCCGAGGT
CCAGTTCAACTGGTACGTGGACGGCGTGGAGGTGCATAATGCCAAGACAAAGCC
ACGGGAGGAGCAGTTCAACAGCACGTTCCGTGTGGTCAGCGTCCTCACCGTTGTG
CACCAGGACTGGCTGAACGGCAAGGAGTACAAGTGCAAGGTCTCCAACAAAGGC
CTCCCAGCCCCCATCGAGAAAACCATCTCCAAAACCAAAGGGCAGCCCCGAGAA
CCACAGGTGTACACCCTGCCCCCATCCCGGGAGGAGATGACCAAGAACCAGGTC
AGCCTGACCTGCCTGGTCAAAGGCTTCTACCCCAGCGACATCGCCGTGGAGTGG
GAGAGCAATGGGCAGCCGGAGAACAACTACAAGACCACGCCTCCCATGCTGGAC
TCCGACGGCTCCTTCTTCCTCTACAGCAAGCTCACCGTGGACAAGAGCAGGTGGC
AGCAGGGGAACGTCTTCTCATGCTCCGTGATGCATGAGGCTCTGCACAACCACTA
CACGCAGAAGAGCCTCTCCCTGTCTCCGGGTAAAGGTGGTGGTGGCTCGGGATC
CGGAGGCTCCGGTGGCGGTGGCAGCAACCCAATTTGCAAGGGATGCTTAAGCTG
TAGCAAGGACAACGGATGTTCACGGTGCCAGCAAAAGCTGTTTTTCTTCCTCCGG
CGGGAAGGAATGCGGCAGTACGGCGAATGTCTCCACTCCTGCCCCTCGGGGTAT
TACGGACACCGCGCGCCTGACATGAACCGATGCGCCAGATGCCGGATCGAGAAC
TGCGATAGCTGCCGCAGCAAGGACGCCTGCACTAAGTGCAAAGTCGGCTTCTAC
CTTCACCGGGGCAGATGTTTTGACGAATGCCCGGATGGCTTCGCCCCGCTGGAGG
AGACTATGGAATGCGTGGAG

LP1-3E20 Heavy chain IgG2, RSPO2 (F105R/F109A) polypeptide (SEQ ID NO: 225)

QVQLQQSGAELAKPGASVKMSCKASGYTFTSYWIHWVKQRPGQGLEWIGYINPSSG
YAEYNQKFKVRATLTADKSSSTAYMQLSSLTSEDSAVYYCARESYYSFDYTMDYW
GQGTSVTVSSASTKGPSVFPLAPCSRSTSESTAALGCLVKDYFPEPVTVSWNSGALTS
GVHTFPAVLQSSGLYSLSSVVTVPSSNFGTQTYTCNVDHKPSNTKVDKTVERKCCVE
CPPCPAPPVAGPSVFLFPPKPKDTLMISRTPEVTCVVVDVSHEDPEVQFNWYVDGVE
VHNAKTKPREEQFNSTFRVVSVLTVVHQDWLNGKEYKCKVSNKGLPAPIEKTISKT
KGQPREPQVYTLPPSREEMTKNQVSLTCLVKGFYPSDIAVEWESNGQPENNYKTTPP
MLDSDGSFFLYSKLTVDKSRWQQGNVFSCSVMHEALHNHYTQKSLSLSPGKGGGGS
GSGGSGGGGSNPICKGCLSCSKDNGCSRCQQKLFFFLRREGMRQYGECLHSCPSGYY
GHRAPDMNRCARCRIENCDSCRSKDACTKCKVGFYLHRGRCFDECPDGFAPLEETM
ECVE

LP1-6H3 light chain polynucleotide (SEQ ID NO: 226)

GATGTTGTGATGACCCAGACTCCACTCACTTTGTCGGTTACCATTGGACAACCAG
CCTCCATCTCTTGCAAGTCAAGTCAGAGCCTCTTAGATAGTGATGGAAAGACATA
TTTGAATTGGTTGTTACAGAGGCCAGGCCAGTCTCCAAAGCGCCTAATCTATCTG
GTGTCTAAACTGGACTCTGGAGTCCCTGACAGGTTCACTGGCAGTGGATCAGGG
ACAGATTTCACACTGAAAATCAGCAGAGTGGAGGCTGAGGATTTGGGAGTTTAT
TATTGCTGGCAAGGTACACATTTTCCTCACACGTTCGGCTCGGGGACAAAGTTGG
AAATAAAACGTACGGTGGCTGCACCATCTGTCTTCATCTTCCCGCCATCTGATGA
GCAGTTGAAATCTGGAACTGCCTCTGTTGTGTGCCTGCTGAATAACTTCTATCCC
AGAGAGGCCAAAGTACAGTGGAAGGTGGATAACGCCCTCCAATCGGGTAACTCC
CAGGAGAGTGTCACAGAGCAGGACAGCAAGGACAGCACCTACAGCCTCAGCAG
CACCCTGACGCTGAGCAAAGCAGACTACGAGAAACACAAAGTCTACGCCTGCGA
AGTCACCCATCAGGGCCTGAGCTCGCCCGTCACAAAGAGCTTCAACAGGGGAGA
GTGT

LP1-6H3 light chain (PN & PP) polypeptide (SEQ ID NO: 227)

DVVMTQTPLTLSVTIGQPASISCKSSQSLLDSDGKTYLNWLLQRPGQSPKRLIYLVSK
LDSGVPDRFTGSGSGTDFTLKISRVEAEDLGVYYCWQGTHFPHTFGSGTKLEIKRTV
AAPSVFIFPPSDEQLKSGTASVVCLLNNFYPREAKVQWKVDNALQSGNSQESVTEQD
SKDSTYSLSSTLTLSKADYEKHKVYACEVTHQGLSSPVTKSFNRGEC

FIG. 11AU

LP1-6H3 Heavy chain IgG2, RSPO2 (F105R/F109A) polynucleotide (SEQ ID NO: 228)

CAGGCTTATCTACAGCAGTCTGGGGCTGAGCTGGTGAGGCCTGGGGCCTCAGTG
AAGATGTCCTGTAAGGCTTCTGGCTACACATTTTCCCGTTTCGATATGCACTGGG
TAAAGCAGACACCTAGACAGGGCCTGGAATGGATTGGAGTTATTTATCCAGGAA
ATGGTGATACTTCCTACAATCAGAAGTTCAGGGACAAGGCCTCACTGACTGTAG
ACAAATCCTCCAGCACAGCCTACATGCAGCTCAGCAGCCTGACATCTGAAGACT
CTGCGGTCTATTTCTGTGCAAGCTCCTACTATGGTAACCCTGGGGCCAAGGCAC
CACTCTCACAGTCTCCAGCGCTAGCACCAAGGGCCCATCGGTCTTCCCCCTGGCG
CCCTGCTCCAGGAGCACCTCCGAGAGCACAGCGGCCCTGGGCTGCCTGGTCAAG
GACTACTTCCCCGAACCGGTGACGGTGTCGTGGAACTCAGGCGCTCTGACCAGC
GGCGTGCACACCTTCCCAGCTGTCCTACAGTCCTCAGGACTCTACTCCCTCAGCA
GCGTGGTGACCGTGCCCTCCAGCAACTTCGGCACCCAGACCTACACCTGCAACGT
AGATCACAAGCCCAGCAACACCAAGGTGGACAAGACAGTTGAGCGCAAATGTTG
TGTCGAGTGCCCACCGTGCCCAGCACCACCTGTGGCAGGACCGTCAGTCTTCCTC
TTCCCCCCAAAACCCAAGGACACCCTCATGATCTCCCGGACCCCTGAGGTCACGT
GCGTGGTGGTGGACGTGAGCCACGAAGACCCCGAGGTCCAGTTCAACTGGTACG
TGGACGGCGTGGAGGTGCATAATGCCAAGACAAAGCCACGGGAGGAGCAGTTC
AACAGCACGTTCCGTGTGGTCAGCGTCCTCACCGTTGTGCACCAGGACTGGCTGA
ACGGCAAGGAGTACAAGTGCAAGGTCTCCAACAAAGGCCTCCCAGCCCCCATCG
AGAAAACCATCTCCAAAACCAAAGGGCAGCCCCGAGAACCACAGGTGTACACCC
TGCCCCCATCCCGGGAGGAGATGACCAAGAACCAGGTCAGCCTGACCTGCCTGG
TCAAAGGCTTCTACCCCAGCGACATCGCCGTGGAGTGGGAGAGCAATGGGCAGC
CGGAGAACAACTACAAGACCACGCCTCCCATGCTGGACTCCGACGGCTCCTTCTT
CCTCTACAGCAAGCTCACCGTGGACAAGAGCAGGTGGCAGCAGGGGAACGTCTT
CTCATGCTCCGTGATGCATGAGGCTCTGCACAACCACTACACGCAGAAGAGCCTC
TCCCTGTCTCCGGGTAAAGGTGGTGGTGGCTCGGGATCCGGAGGCTCCGGTGGC
GGTGGCAGCAACCCAATTTGCAAGGGATGCTTAAGCTGTAGCAAGGACAACGGA
TGTTCACGGTGCCAGCAAAAGCTGTTTTTCTTCCTCCGGCGGGAAGGAATGCGGC
AGTACGGCGAATGTCTCCACTCCTGCCCCTCGGGGTATTACGGACACCGCGCGCC
TGACATGAACCGATGCGCCAGATGCCGGATCGAGAACTGCGATAGCTGCCGCAG
CAAGGACGCCTGCACTAAGTGCAAAGTCGGCTTCTACCTTCACCGGGGCAGATG
TTTTGACGAATGCCCGGATGGCTTCGCCCCGCTGGAGGAGACTATGGAATGCGTG
GAG

LP1-6H3 Heavy chain IgG2, RSPO2 (F105R/F109A) polypeptide (SEQ ID NO: 229)

QAYLQQSGAELVRPGASVKMSCKASGYTFSRFDMHWVKQTPRQGLEWIGVIYPGN
GDTSYNQKFRDKASLTVDKSSSTAYMQLSSLTSEDSAVYFCASSYYGNPWGQGTTL
TVSSASTKGPSVFPLAPCSRSTSESTAALGCLVKDYFPEPVTVSWNSGALTSGVHTFP
AVLQSSGLYSLSSVVTVPSSNFGTQTYTCNVDHKPSNTKVDKTVERKCCVECPPCPA
PPVAGPSVFLFPPKPKDTLMISRTPEVTCVVVDVSHEDPEVQFNWYVDGVEVHNAK
TKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGKGGGGSGSGGSG
GGGSNPICKGCLSCSKDNGCSRCQQKLFFFLRREGMRQYGECLHSCPSGYYGHRAP
DMNRCARCRIENCDSCRSKDACTKCKVGFYLHRGRCFDECPDGFAPLEETMECVE

FIG. 11AV

LP1-7B13 light chain polynucleotide (SEQ ID NO: 230)

GATATTGTGCTAACTCAGTCTCCAGCCACCCTGTCTGTGACTCCAGGAGATAGAG
TCAGTCTTTCCTGCAGGGCCAGTCAAAGTATTAGCAACTACCTACACTGGTATCA
ACAAAAATCACATGAGTCTCCAAGGCTTCTCATCAAGTTTGCTTCCCAGTCCATC
TCTGGGATCCCTCCAGGTTCAGTGGCAGTGGATCAGGGACGGATTTCACTCTCA
CTATCAACAGTGTGGAGACTGAAGATTTTGGAATGTATTCTGTCAACAGAGTAA
CAGCTGGCCGCTCACGTTCGGTGCTGGGACCAAGCTGGAGCTGAAACGTACGGT
GGCTGCACCATCTGTCTTCATCTTCCCGCCATCTGATGAGCAGTTGAAATCTGGA
ACTGCCTCTGTTGTGTGCCTGCTGAATAACTTCTATCCCAGAGAGGCCAAAGTAC
AGTGGAAGGTGGATAACGCCCTCCAATCGGGTAACTCCCAGGAGAGTGTCACAG
AGCAGGACAGCAAGGACAGCACCTACAGCCTCAGCAGCACCCTGACGCTGAGCA
AAGCAGACTACGAGAAACACAAAGTCTACGCCTGCGAAGTCACCCATCAGGGCC
TGAGCTCGCCCGTCACAAAGAGCTTCAACAGGGGAGAGTGT

LP1-7B13 light chain polypeptide (SEQ ID NO: 231)

DIVLTQSPATLSVTPGDRVSLSCRASQSISNYLHWYQQKSHESPRLLIKFASQSISGIPS
RFSGSGSGTDFTLTINSVETEDFGMYFCQQSNSWPLTFGAGTKLELKRTVAAPSVFIF
PPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

FIG. 11AW

LP1-7B13 Heavy chain IgG2, RSPO2 (F105R/F109A) polynucleotide (SEQ ID NO: 232)

GAGGTCCAGCTGCAACAATCTGGACCTGAGGTGGTGAAGCCTGGGGCTTCAGTG
AAGATGTCCTGTAAGACTTCTGGATTCACATTCACTGACTACTACATGAACTGGG
TGAAGCAGGGTCATGGAAAGAGCCTTGAGTGGATTGGACGTGTTAATCCTAGCA
ATGATGATACTAGGTACAATCAGAAGTTCAAGGGAAAGGCCACATTGACAGTAG
ACAAGTCCCTCAGCACAGCCTACATGCAGCTCAACAGCCTGACATCTGAGGACT
CTGCGGTCTATTACTGTACAAGGTGGTTCTACTTTGACTACTGGGGCCAAGGCAC
TACTCTCACAGTCTCCAGCGCTAGCACCAAGGGCCCATCGGTCTTCCCCCTGGCG
CCCTGCTCCAGGAGCACCTCCGAGAGCACAGCGGCCCTGGGCTGCCTGGTCAAG
GACTACTTCCCCGAACCGGTGACGGTGTCGTGGAACTCAGGCGCTCTGACCAGC
GGCGTGCACACCTTCCCAGCTGTCCTACAGTCCTCAGGACTCTACTCCCTCAGCA
GCGTGGTGACCGTGCCCTCCAGCAACTTCGGCACCCAGACCTACACCTGCAACGT
AGATCACAAGCCCAGCAACACCAAGGTGGACAAGACAGTTGAGCGCAAATGTTG
TGTCGAGTGCCCACCGTGCCCAGCACCACCTGTGGCAGGACCGTCAGTCTTCCTC
TTCCCCCCAAAACCCAAGGACACCCTCATGATCTCCCGGACCCCTGAGGTCACGT
GCGTGGTGGTGGACGTGAGCCACGAAGACCCCGAGGTCCAGTTCAACTGGTACG
TGGACGGCGTGGAGGTGCATAATGCCAAGACAAAGCCACGGGAGGAGCAGTTC
AACAGCACGTTCCGTGTGGTCAGCGTCCTCACCGTTGTGCACCAGGACTGGCTGA
ACGGCAAGGAGTACAAGTGCAAGGTCTCCAACAAAGGCCTCCCAGCCCCCATCG
AGAAAACCATCTCCAAAACCAAAGGGCAGCCCCGAGAACCACAGGTGTACACCC
TGCCCCCATCCCGGGAGGAGATGACCAAGAACCAGGTCAGCCTGACCTGCCTGG
TCAAAGGCTTCTACCCCAGCGACATCGCCGTGGAGTGGGAGAGCAATGGGCAGC
CGGAGAACAACTACAAGACCACGCCTCCCATGCTGGACTCCGACGGCTCCTTCTT
CCTCTACAGCAAGCTCACCGTGGACAAGAGCAGGTGGCAGCAGGGGAACGTCTT
CTCATGCTCCGTGATGCATGAGGCTCTGCACAACCACTACACGCAGAAGAGCCTC
TCCCTGTCTCCGGGTAAAGGTGGTGGTGGCTCGGGATCCGGAGGCTCCGGTGGC
GGTGGCAGCAACCCAATTTGCAAGGGATGCTTAAGCTGTAGCAAGGACAACGGA
TGTTCACGGTGCCAGCAAAAGCTGTTTTTCTTCCTCCGGCGGGAAGGAATGCGGC
AGTACGGCGAATGTCTCCACTCCTGCCCCTCGGGGTATTACGGACACCGCGCGCC
TGACATGAACCGATGCGCCAGATGCCGGATCGAGAACTGCGATAGCTGCCGCAG
CAAGGACGCCTGCACTAAGTGCAAAGTCGGCTTCTACCTTCACCGGGGCAGATG
TTTTGACGAATGCCCGGATGGCTTCGCCCCGCTGGAGGAGACTATGGAATGCGTG
GAG

LP1-7B13 Heavy chain IgG2, RSPO2 (F105R/F109A) polypeptide (SEQ ID NO: 233)

EVQLQQSGPEVVKPGASVKMSCKTSGFTFTDYYMNWVKQGHGKSLEWIGRVNPSN
DDTRYNQKFKGKATLTVDKSLSTAYMQLNSLTSEDSAVYYCTRWFYFDYWGQGTT
LTVSSASTKGPSVFPLAPCSRSTSESTAALGCLVKDYFPEPVTVSWNSGALTSGVHTF
PAVLQSSGLYSLSSVVTVPSSNFGTQTYTCNVDHKPSNTKVDKTVERKCCVECPPCP
APPVAGPSVFLFPPKPKDTLMISRTPEVTCVVVDVSHEDPEVQFNWYVDGVEVHNA
KTKPREEQFNSTFRVVSVLTVVHQDWLNGKEYKCKVSNKGLPAPIEKTISKTKGQPR
EPQVYTLPPSREEMTKNQVSLTCLVKGFYPSDIAVEWESNGQPENNYKTTPPMLDSD
GSFFLYSKLTVDKSRWQQGNVFSCSVMHEALHNHYTQKSLSLSPGKGGGGSGSGGS
GGGGSNPICKGCLSCSKDNGCSRCQQKLFFFLRREGMRQYGECLHSCPSGYYGHRA
PDMNRCARCRIENCDSCRSKDACTKCKVGFYLHRGRCFDECPDGFAPLEETMECVE

FIG. 11AX

LP1-7I20 light chain polynucleotide (SEQ ID NO: 234)

GACATCCAGATGACTCAGTCTCCAGCCTCCCTATCTGCATCTGTGGGAGAAACTG
TCACCATCACATGTCGAACAAGTGAGAATATTTACAGTTATTTAGCATGGTATCA
GCAGAAACAGGGAAAATCTCCTCAGCTCCTGGTCTATAATGCAAAAACCTTAGC
AAAAGGTGTGCCATCAAGGTTCAGTGGCAGTGGATCAGGCACACAGTTTTCTCTG
AAGATCAACGGCCTGCAGCCTGAAGATTTTGGGAATTATTACTGTCAACATCATT
ATGGTACTCCGTACACGTTCGGAGGGGGGACCAAGGTGGAAATAAAACGTACGG
TGGCTGCACCATCTGTCTTCATCTTCCCGCCATCTGATGAGCAGTTGAAATCTGG
AACTGCCTCTGTTGTGTGCCTGCTGAATAACTTCTATCCCAGAGAGGCCAAAGTA
CAGTGGAAGGTGGATAACGCCCTCCAATCGGGTAACTCCCAGGAGAGTGTCACA
GAGCAGGACAGCAAGGACAGCACCTACAGCCTCAGCAGCACCCTGACGCTGAGC
AAAGCAGACTACGAGAAACACAAAGTCTACGCCTGCGAAGTCACCCATCAGGGC
CTGAGCTCGCCCGTCACAAAGAGCTTCAACAGGGGAGAGTGT

LP1-7I20 light chain polypeptide (SEQ ID NO: 235)

DIQMTQSPASLSASVGETVTITCRTSENIYSYLAWYQQKQGKSPQLLVYNAKTLAKG
VPSRFSGSGSGTQFSLKINGLQPEDFGNYYCQHHYGTPYTFGGGTKVEIKRTVAAPS
VFIFPPSDEQLKSGTASVVCLLNNFYPREAKVQWKVDNALQSGNSQESVTEQDSKDS
TYSLSSTLTLSKADYEKHKVYACEVTHQGLSSPVTKSFNRGEC

FIG. 11AY

LP1-7I20 Heavy chain IgG2, RSPO2 (F105R/F109A) polynucleotide (SEQ ID NO: 236)

GAGGTGAAGCTGGTGGAGTCTGGAGGAGGCTTGGTACAGCCTGGGGGTTCTCTG
AGTCTCTCCTGTGCAGCTTCTGGATTCACCTTCACTGATTACTACATGAGCTGGGT
CCGCCAGCCCCCAGGGAAGGCACTTGAGTGGTTGGCTTTGATTAGAAACAAAGC
TAATGGTTACACAACAGAGTACAGTGCATCTGTGAAGGGTCGGTTCACCATCTCC
AGGGATAATTCCCAAAGCATCCTCTATCTTCAAATGAATGCCCTGAGAGCTGAGG
ACAGTGCCACTTATTACTGTGCAGTTACCTACGGGGCTTACTGGGGCCAAGGGAC
TCTGGTCACTGTCTCTGCAGCTAGCACCAAGGGCCCATCGGTCTTCCCCCTGGCG
CCCTGCTCCAGGAGCACCTCCGAGAGCACAGCGGCCCTGGGCTGCCTGGTCAAG
GACTACTTCCCCGAACCGGTGACGGTGTCGTGGAACTCAGGCGCTCTGACCAGC
GGCGTGCACACCTTCCCAGCTGTCCTACAGTCCTCAGGACTCTACTCCCTCAGCA
GCGTGGTGACCGTGCCCTCCAGCAACTTCGGCACCCAGACCTACACCTGCAACGT
AGATCACAAGCCCAGCAACACCAAGGTGGACAAGACAGTTGAGCGCAAATGTTG
TGTCGAGTGCCCACCGTGCCCAGCACCACCTGTGGCAGGACCGTCAGTCTTCCTC
TTCCCCCCAAAACCCAAGGACACCCTCATGATCTCCCGGACCCCTGAGGTCACGT
GCGTGGTGGTGGACGTGAGCCACGAAGACCCCGAGGTCCAGTTCAACTGGTACG
TGGACGGCGTGGAGGTGCATAATGCCAAGACAAAGCCACGGGAGGAGCAGTTC
AACAGCACGTTCCGTGTGGTCAGCGTCCTCACCGTTGTGCACCAGGACTGGCTGA
ACGGCAAGGAGTACAAGTGCAAGGTCTCCAACAAAGGCCTCCCAGCCCCCATCG
AGAAAACCATCTCCAAAACCAAAGGGCAGCCCCGAGAACCACAGGTGTACACCC
TGCCCCCATCCCGGGAGGAGATGACCAAGAACCAGGTCAGCCTGACCTGCCTGG
TCAAAGGCTTCTACCCCAGCGACATCGCCGTGGAGTGGGAGAGCAATGGGCAGC
CGGAGAACAACTACAAGACCACGCCTCCCATGCTGGACTCCGACGGCTCCTTCTT
CCTCTACAGCAAGCTCACCGTGGACAAGAGCAGGTGGCAGCAGGGGAACGTCTT
CTCATGCTCCGTGATGCATGAGGCTCTGCACAACCACTACACGCAGAAGAGCCTC
TCCCTGTCTCCGGGTAAAGGTGGTGGTGGCTCGGGATCCGGAGGCTCCGGTGGC
GGTGGCAGCAACCCAATTTGCAAGGGATGCTTAAGCTGTAGCAAGGACAACGGA
TGTTCACGGTGCCAGCAAAAGCTGTTTTTCTTCCTCCGGCGGGAAGGAATGCGGC
AGTACGGCGAATGTCTCCACTCCTGCCCCTCGGGGTATTACGGACACCGCGCGCC
TGACATGAACCGATGCGCCAGATGCCGGATCGAGAACTGCGATAGCTGCCGCAG
CAAGGACGCCTGCACTAAGTGCAAAGTCGGCTTCTACCTTCACCGGGGCAGATG
TTTTGACGAATGCCCGGATGGCTTCGCCCCGCTGGAGGAGACTATGGAATGCGTG
GAG

LP1-7I20 Heavy chain IgG2, RSPO2 (F105R/F109A) polypeptide (SEQ ID NO: 237)

EVKLVESGGGLVQPGGSLSLSCAASGFTFTDYYMSWVRQPPGKALEWLALIRNKAN
GYTTEYSASVKGRFTISRDNSQSILYLQMNALRAEDSATYYCAVTYGAYWGQGTLV
TVSAASTKGPSVFPLAPCSRSTSESTAALGCLVKDYFPEPVTVSWNSGALTSGVHTFP
AVLQSSGLYSLSSVVTVPSSNFGTQTYTCNVDHKPSNTKVDKTVERKCCVECPPCPA
PPVAGPSVFLFPPKPKDTLMISRTPEVTCVVVDVSHEDPEVQFNWYVDGVEVHNAK
TKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGKGGGGSGSGGSG
GGGSNPICKGCLSCSKDNGCSRCQQKLFFFLRREGMRQYGECLHSCPSGYYGHRAP
DMNRCARCRIENCDSCRSKDACTKCKVGFYLHRGRCFDECPDGFAPLEETMECVE

LP1-8M24 light chain polynucleotide (SEQ ID NO: 238)

GAGGTTCAGCTGCAGCAGTCTGGGGCTGAGCTTGTGAGGCCAGGGGCCTCAGTC
AAGTTGTCCTGCACAGCTTCTGGCTTTACCATTAAAGACGACTATATTCACTGGG
TGAAGCAGGGGCCTGAACAGGGCCTGGAGTGGATTGGAAGAATTGATCCTGCGG
ATGATGATACTAAATATGCCCCGAAGTTCCAGGACAAGGCCACTATAACTGCAG
ACACATCCTCCAACACAGCCTACCTGCAGCTCAGCAGCCTGACATCTGAGGACA
CTGCCGTCTATTACTGTGCTAGAAGTTCCATGGCCTGGTTTGCTTACTGGGCCCA
AGGGACTCTGGTCACTGTCTCTACAGCTAGCACCAAGGGCCCATCGGTCTTCCCC
CTGGCACCCTCCTCCAAGAGCACCTCTGGGGGCACAGCGGCCCTGGGCTGCCTG
GTCAAGGACTACTTCCCCGAACCGGTGACGGTGTCGTGGAACTCAGGCGCCCTG
ACCAGCGGCGTGCACACCTTCCCGGCTGTCCTACAGTCCTCAGGACTCTACTCCC
TCAGCAGCGTGGTGACCGTGCCCTCCAGCAGCTTGGGCACCCAGACCTACATCTG
CAACGTGAATCACAAGCCCAGCAACACCAAGGTGGACAAGAAAGTTGAGCCCA
AATCTTGTGGATCCGGCTCCGGAcatcatcatcaccatcac

LP1-8M24 light chain polypeptide (SEQ ID NO: 239)

EVQLQQSGAELVRPGASVKLSCTASGFTIKDDYIHWVKQGPEQGLEWIGRIDPADDD
TKYAPKFQDKATITADTSSNTAYLQLSSLTSEDTAVYYCARSSMAWFAYWAQGTLV
TVSTASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCGSGSGHHH
HHH

FIG. 11BA

LP1-8M24 Heavy chain IgG2, RSPO2 (F105R/F109A) polynucleotide (SEQ ID NO: 240)

GACATCCAGATGACACAGAGCCCTAGCAGCCTGTCTGCCAGCGTGGGAGACAGA
GTGACCATCACCTGTCGGATCAGCGAGAACATCTACAGCAACCTGGCCTGGTATC
AGCAGAAGCCTGGCAAGGCCCCTAAGCTGCTGATCTACGCCGCCATCAATCTGG
CCGATGGCGTGCCAAGCAGATTTTCTGGCAGCGGCTCTGGCACCGACTTCACCCT
GACCATATCTAGCCTGCAGCCTGAGGACTTCGCCACCTACTACTGCCAGCACTTT
TGGGGCACCCCTTTCACCTTTGGCCAGGGCACCAAGCTGGAAATCAAGCGTACG
GTGGCTGCACCATCTGTCTTCATCTTCCCGCCATCTGATGAGCAGTTGAAATCTG
GAACTGCCTCTGTTGTGTGCCTGCTGAATAACTTCTATCCCAGAGAGGCCAAAGT
ACAGTGGAAGGTGGATAACGCCCTCCAATCGGGTAACTCCCAGGAGAGTGTCAC
AGAGCAGGACAGCAAGGACAGCACCTACAGCCTCAGCAGCACCCTGACGCTGAG
CAAAGCAGACTACGAGAAACACAAAGTCTACGCCTGCGAAGTCACCCATCAGGG
CCTGAGCTCGCCCGTCACAAAGAGCTTCAACAGGGGAGAGTGT

LP1-8M24 Heavy chain IgG2, RSPO2 (F105R/F109A) polypeptide (SEQ ID NO: 241

DIQMTQSPSSLSASVGDRVTITCRISENIYSNLAWYQQKPGKAPKLLIYAAINLADGV
PSRFSGSGSGTDFTLTISSLQPEDFATYYCQHFWGTPFTFGQGTKLEIKRTVAAPSVFI
FPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC

FIG. 11BB

LP1-9C3 light chain polynucleotide (SEQ ID NO: 242)

GATGTTGTGGTGACTCAAACTCCACTCTCCCTGCCTGTCAGCTTTGGAGATCAAG
TTTCTATCTCTTGCAGGTCTAGTCAGAGTCTTGCAAACAGTTATGGGAACACCTA
TTTGTCTTGGTACCTGCACAAGCCTGGCCAGTCTCCACAGCTCCTCATCTATGGG
ATTTCCAACAGATTTTCTGGGGTGCCAGACAGGTTCAGTGGCAGTGGTTCAGGGA
CAGATTTCACACTCAAGATCAGCACAATAAAGCCTGAGGACTTGGGAATCTATT
ACTGCTTACAAGCTACACATCAGCCGTGGACGTTCGGTGGAGGCACCAAGCTGG
AAATCAAACGTACGGTGGCTGCACCATCTGTCTTCATCTTCCCGCCATCTGATGA
GCAGTTGAAATCTGGAACTGCCTCTGTTGTGTGCCTGCTGAATAACTTCTATCCC
AGAGAGGCCAAAGTACAGTGGAAGGTGGATAACGCCCTCCAATCGGGTAACTCC
CAGGAGAGTGTCACAGAGCAGGACAGCAAGGACAGCACCTACAGCCTCAGCAG
CACCCTGACGCTGAGCAAAGCAGACTACGAGAAACACAAAGTCTACGCCTGCGA
AGTCACCCATCAGGGCCTGAGCTCGCCCGTCACAAAGAGCTTCAACAGGGGAGA
GTGT

LP1-9C3 light chain polypeptide (SEQ ID NO: 243)

DVVVTQTPLSLPVSFGDQVSISCRSSQSLANSYGNTYLSWYLHKPGQSPQLLIYGISN
RFSGVPDRFSGSGSGTDFTLKISTIKPEDLGIYYCLQATHQPWTFGGGTKLEIKRTVA
APSVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC

FIG. 11BC

LP1-9C3 Heavy chain IgG2, RSPO2 (F105R/F109A) polynucleotide (SEQ ID NO: 244)

CAGGTTACTCTGAAAGAGTCTGGCCCTGGGATATTGCAGCCCTCCCAGACCCTCA
GTCTGACTTGTTCTTTCTCTGGGTTTTCACTGAGCACTTCTTATATGGGTGTGAGC
TGGATTCGTAAGCCTTCAGGAAAGGGTCTGGAGTGGCTGGCACACATTTTCTGGG
ATGATGACAAGCGCTATAACCCATCCCTGAAGAGCCGGCTCACAATCTCCAAGG
ATACCTCCAGCAACCAGGTATTCCTCATGATCACCAGTGTGGAAACTGCAGATAC
TGCCACATACTACTGTGGGGGTCCCTACTATCCGTTTACTTACTGGGGCCAAGGG
ACTCTGGTCACTGTCTCTGCAGCTAGCACCAAGGGCCCATCGGTCTTCCCCCTGG
CGCCCTGCTCCAGGAGCACCTCCGAGAGCACAGCGGCCCTGGGCTGCCTGGTCA
AGGACTACTTCCCCGAACCGGTGACGGTGTCGTGGAACTCAGGCGCTCTGACCA
GCGGCGTGCACACCTTCCCAGCTGTCCTACAGTCCTCAGGACTCTACTCCCTCAG
CAGCGTGGTGACCGTGCCCTCCAGCAACTTCGGCACCCAGACCTACACCTGCAAC
GTAGATCACAAGCCCAGCAACACCAAGGTGGACAAGACAGTTGAGCGCAAATGT
TGTGTCGAGTGCCCACCGTGCCCAGCACCACCTGTGGCAGGACCGTCAGTCTTCC
TCTTCCCCCCAAAACCCAAGGACACCCTCATGATCTCCCGGACCCCTGAGGTCAC
GTGCGTGGTGGTGGACGTGAGCCACGAAGACCCCGAGGTCCAGTTCAACTGGTA
CGTGGACGGCGTGGAGGTGCATAATGCCAAGACAAAGCCACGGGAGGAGCAGT
TCAACAGCACGTTCCGTGTGGTCAGCGTCCTCACCGTTGTGCACCAGGACTGGCT
GAACGGCAAGGAGTACAAGTGCAAGGTCTCCAACAAAGGCCTCCCAGCCCCCAT
CGAGAAAACCATCTCCAAAACCAAAGGGCAGCCCCGAGAACCACAGGTGTACAC
CCTGCCCCCATCCCGGGAGGAGATGACCAAGAACCAGGTCAGCCTGACCTGCCT
GGTCAAAGGCTTCTACCCCAGCGACATCGCCGTGGAGTGGGAGAGCAATGGGCA
GCCGGAGAACAACTACAAGACCACGCCTCCCATGCTGGACTCCGACGGCTCCTT
CTTCCTCTACAGCAAGCTCACCGTGGACAAGAGCAGGTGGCAGCAGGGGAACGT
CTTCTCATGCTCCGTGATGCATGAGGCTCTGCACAACCACTACACGCAGAAGAGC
CTCTCCCTGTCTCCGGGTAAAGGTGGTGGTGGCTCGGGATCCGGAGGCTCCGGTG
GCGGTGGCAGCAACCCAATTTGCAAGGGATGCTTAAGCTGTAGCAAGGACAACG
GATGTTCACGGTGCCAGCAAAAGCTGTTTTTCTTCCTCCGGCGGGAAGGAATGCG
GCAGTACGGCGAATGTCTCCACTCCTGCCCCTCGGGGTATTACGGACACCGCGCG
CCTGACATGAACCGATGCGCCAGATGCCGGATCGAGAACTGCGATAGCTGCCGC
AGCAAGGACGCCTGCACTAAGTGCAAAGTCGGCTTCTACCTTCACCGGGGCAGA
TGTTTTGACGAATGCCCGGATGGCTTCGCCCCGCTGGAGGAGACTATGGAATGCG
TGGAG

LP1-9C3 Heavy chain IgG2, RSPO2 (F105R/F109A) polypeptide (SEQ ID NO: 245)

QVTLKESGPGILQPSQTLSLTCSFSGFSLSTSYMGVSWIRKPSGKGLEWLAHIFWDDD
KRYNPSLKSRLTISKDTSSNQVFLMITSVETADTATYYCGGPYYPFTYWGQGTLVTV
SAASTKGPSVFPLAPCSRSTSESTAALGCLVKDYFPEPVTVSWNSGALTSGVHTFPAV
LQSSGLYSLSSVVTVPSSNFGTQTYTCNVDHKPSNTKVDKTVERKCCVECPPCPAPP
VAGPSVFLFPPKPKDTLMISRTPEVTCVVVDVSHEDPEVQFNWYVDGVEVHNAKTK
PREEQFNSTFRVVSVLTVVHQDWLNGKEYKCKVSNKGLPAPIEKTISKTKGQPREPQ
VYTLPPSREEMTKNQVSLTCLVKGFYPSDIAVEWESNGQPENNYKTTPPMLDSDGSF
FLYSKLTVDKSRWQQGNVFSCSVMHEALHNHYTQKSLSLSPGKGGGGSGSGGSGG
GGSNPICKGCLSCSKDNGCSRCQQKLFFFLRREGMRQYGECLHSCPSGYYGHRAPD
MNRCARCRIENCDSCRSKDACTKCKVGFYLHRGRCFDECPDGFAPLEETMECVE

FIG. 11BD

LP1-9M16 light chain polynucleotide (SEQ ID NO: 246)

GACATCAAGATGACCCAGTCTCCATCTTCCATGTATGCATCTCTAGGAGAGAGAG
TCACTATCACTTGCAAGGCGAGTCAGGACATTAATAGCTATTTAAGCTGGTTCCA
GCAGAAACCAGGGAAATCTCCTAAGACCCTGATCTATCGTGCAAACAGATTGGC
AGATGGGGTCCCATCAAGGTTCAGTGGCAGTGGATCTGGGCAAGATTATTCTCTC
ACCATCAGCAACCTGGAGTATGAAGATATGGGAATTTATTATTGTCTACAGTATG
ATGAGTTTCCGCTCACGTTCGGTGCTGGGACCAAGCTGGAGCTGAAACGTACGGT
GGCTGCACCATCTGTCTTCATCTTCCCGCCATCTGATGAGCAGTTGAAATCTGGA
ACTGCCTCTGTTGTGTGCCTGCTGAATAACTTCTATCCCAGAGAGGCCAAAGTAC
AGTGGAAGGTGGATAACGCCCTCCAATCGGGTAACTCCCAGGAGAGTGTCACAG
AGCAGGACAGCAAGGACAGCACCTACAGCCTCAGCAGCACCCTGACGCTGAGCA
AAGCAGACTACGAGAAACACAAAGTCTACGCCTGCGAAGTCACCCATCAGGGCC
TGAGCTCGCCCGTCACAAAGAGCTTCAACAGGGGAGAGTGT

LP1-9M16 light chain polypeptide (SEQ ID NO: 247)

DIKMTQSPSSMYASLGERVTITCKASQDINSYLSWFQQKPGKSPKTLIYRANRLADG
VPSRFSGSGSGQDYSLTISNLEYEDMGIYYCLQYDEFPLTFGAGTKLELKRTVAAPSV
FIFPPSDEQLKSGTASVVCLLNNFYPREAKVQWKVDNALQSGNSQESVTEQDSKDST
YSLSSTLTLSKADYEKHKVYACEVTHQGLSSPVTKSFNRGEC

FIG. 11BE

LP1-9M16 Heavy chain IgG2, RSPO2 (F105R/F109A) polynucleotide (SID NO: 248)

GAGGTCCAGCTGCAACAGTCTGGACCTGAGCTGGTGAAGCCTGGGGCTTCAGTG
AAGATGTCCTGTAAGGCTTCTGGATACACATTCACTGACTACTACATGAACTGGG
TGAAGCAGAGTCATGGAAAGAGCCTTGAGTGGATTGGACGTGTTAATCCTAACA
ATGGTGGTTCTAACTACAACCAGAAATTCAAGGGCAAGGCCACATTGACAGTAG
ACAAATCCCTCAGCACAGCCTACATGCAGCTCAACAGCCTGACATCTGAGGACT
CTGCGGTCTATTACTGTGCAAGTCGAAACTTCGATGTCTGGGGCGCAGGGACCAC
GGTCACCGTCTCCAGCGCTAGCACCAAGGGCCCATCGGTCTTCCCCCTGGCGCCC
TGCTCCAGGAGCACCTCCGAGAGCACAGCGGCCCTGGGCTGCCTGGTCAAGGAC
TACTTCCCCGAACCGGTGACGGTGTCGTGGAACTCAGGCGCTCTGACCAGCGGC
GTGCACACCTTCCCAGCTGTCCTACAGTCCTCAGGACTCTACTCCCTCAGCAGCG
TGGTGACCGTGCCCTCCAGCAACTTCGGCACCCAGACCTACACCTGCAACGTAGA
TCACAAGCCCAGCAACACCAAGGTGGACAAGACAGTTGAGCGCAAATGTTGTGT
CGAGTGCCCACCGTGCCCAGCACCACCTGTGGCAGGACCGTCAGTCTTCCTCTTC
CCCCCAAAACCCAAGGACACCCTCATGATCTCCCGGACCCCTGAGGTCACGTGC
GTGGTGGTGGACGTGAGCCACGAAGACCCCGAGGTCCAGTTCAACTGGTACGTG
GACGGCGTGGAGGTGCATAATGCCAAGACAAAGCCACGGGAGGAGCAGTTCAA
CAGCACGTTCCGTGTGGTCAGCGTCCTCACCGTTGTGCACCAGGACTGGCTGAAC
GGCAAGGAGTACAAGTGCAAGGTCTCCAACAAAGGCCTCCCAGCCCCCATCGAG
AAAACCATCTCCAAAACCAAAGGGCAGCCCCGAGAACCACAGGTGTACACCCTG
CCCCCATCCCGGGAGGAGATGACCAAGAACCAGGTCAGCCTGACCTGCCTGGTC
AAAGGCTTCTACCCCAGCGACATCGCCGTGGAGTGGGAGAGCAATGGGCAGCCG
GAGAACAACTACAAGACCACGCCTCCCATGCTGGACTCCGACGGCTCCTTCTTCC
TCTACAGCAAGCTCACCGTGGACAAGAGCAGGTGGCAGCAGGGGAACGTCTTCT
CATGCTCCGTGATGCATGAGGCTCTGCACAACCACTACACGCAGAAGAGCCTCTC
CCTGTCTCCGGGTAAAGGTGGTGGTGGCTCGGGATCCGGAGGCTCCGGTGGCGG
TGGCAGCAACCCAATTTGCAAGGGATGCTTAAGCTGTAGCAAGGACAACGGATG
TTCACGGTGCCAGCAAAAGCTGTTTTTCTTCCTCCGGCGGGAAGGAATGCGGCAG
TACGGCGAATGTCTCCACTCCTGCCCCTCGGGGTATTACGGACACCGCGCGCCTG
ACATGAACCGATGCGCCAGATGCCGGATCGAGAACTGCGATAGCTGCCGCAGCA
AGGACGCCTGCACTAAGTGCAAAGTCGGCTTCTACCTTCACCGGGGCAGATGTTT
TGACGAATGCCCGGATGGCTTCGCCCCGCTGGAGGAGACTATGGAATGCGTGGA
G

LP1-9M16 Heavy chain IgG2, RSPO2 (F105R/F109A) polypeptide (SEQ ID NO: 249)

EVQLQQSGPELVKPGASVKMSCKASGYTFTDYYMNWVKQSHGKSLEWIGRVNPNN
GGSNYNQKFKGKATLTVDKSLSTAYMQLNSLTSEDSAVYYCASRNFDVWGAGTTV
TVSSASTKGPSVFPLAPCSRSTSESTAALGCLVKDYFPEPVTVSWNSGALTSGVHTFP
AVLQSSGLYSLSSVVTVPSSNFGTQTYTCNVDHKPSNTKVDKTVERKCCVECPPCPA
PPVAGPSVFLFPPKPKDTLMISRTPEVTCVVVDVSHEDPEVQFNWYVDGVEVHNAK
TKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDG
SFFLYSKLTVDKSRWQQGNVFSCSVMHEALHNHYTQKSLSLSPGKGGGGSGSGGSG
GGSNPICKGCLSCSKDNGCSRCQQKLFFFLRREGMRQYGECLHSCPSGYYGHRAP
DMNRCARCRIENCDSCRSKDACTKCKVGFYLHRGRCFDECPDGFAPLEETMECVE

LP1-10C22 light chain polynucleotide (SEQ ID NO: 250)

GATGTTTTGATGACCCAAACTCCACTCTCCCTGCCTGTCAGTCTTGGAGATCAAG
CCTCCATCTCTTGCAGATCTAGTCAGGGCATTGTACATAGTAATGGAAACATCTA
TTTAGAATGGTACCTGCAGAAACCAGGCCAGTCTCCAAAGCTCCTGATCTACAAA
GTTTCCAACCGATTTTCTGGGGTCCCAGACAGGTTCAGTGGCAGTGGATCAGGGA
CAGATTTCACACTCAAGATCAGCAGAGTGGAGGCTGAGGATCTGGGAGTTTATT
ACTGCTTTCAAGGTTCACATGTTCCTCCACGTTCGGAGGGGGGACCAAGCTGGA
AATAAAACGTACGGTGGCTGCACCATCTGTCTTCATCTTCCCGCCATCTGATGAG
CAGTTGAAATCTGGAACTGCCTCTGTTGTGTGCCTGCTGAATAACTTCTATCCCA
GAGAGGCCAAAGTACAGTGGAAGGTGGATAACGCCCTCCAATCGGGTAACTCCC
AGGAGAGTGTCACAGAGCAGGACAGCAAGGACAGCACCTACAGCCTCAGCAGC
ACCCTGACGCTGAGCAAAGCAGACTACGAGAAACACAAAGTCTACGCCTGCGAA
GTCACCCATCAGGGCCTGAGCTCGCCCGTCACAAAGAGCTTCAACAGGGGAGAG
TGT

LP1-10C22 light chain polypeptide (SEQ ID NO: 251)

DVLMTQTPLSLPVSLGDQASISCRSSQGIVHSNGNIYLEWYLQKPGQSPKLLIYKVSN
RFSGVPDRFSGSGSGTDFTLKISRVEAEDLGVYYCFQGSHVPPTFGGGTKLEIKRTVA
APSVFIFPPSDEQLKSGTASVVCLLNNFYPREAKVQWKVDNALQSGNSQESVTEQDS
KDSTYSLSSTLTLSKADYEKHKVYACEVTHQGLSSPVTKSFNRGEC

FIG. 11BG

LP1-10C22 Heavy chain IgG2, RSPO2 (F105R/F109A) polynucleotide (SID NO: 252)

GAGGTGCAGCTGGTGGAGTCTGGGGGAGACTTAGTGAAGCCTGGAGGGTCCCTG
AAACTCTCCTGTGCAGCCTCTGGATTCACTTTCAGTAGTTATGGCATGTCTTGGGT
TCGCCAGACTCCAGACAAGAGGCTGGAGTGGGTCGCAAGTATTAGTAGTGGTGG
TAGTTATACCTACTATCCAGACAGTGTGAAGGGGCGATTCACCATCTCCAGAGAC
AATGCCCAGAACACCCTGTACCTGCAAATGAGCAGTCTGAAGTCTGAGGACACA
GCCATGTATTACTGTGTAAGACATGAGGAGTATGGTAAATCCGGATTTGCTTACT
GGGGCCAAGGGACCCTGATTACTGTCTCTGCAGCTAGCACCAAGGGCCCATCGG
TCTTCCCCCTGGCGCCCTGCTCCAGGAGCACCTCCGAGAGCACAGCGGCCCTGGG
CTGCCTGGTCAAGGACTACTTCCCCGAACCGGTGACGGTGTCGTGGAACTCAGGC
GCTCTGACCAGCGGCGTGCACACCTTCCCAGCTGTCCTACAGTCCTCAGGACTCT
ACTCCCTCAGCAGCGTGGTGACCGTGCCCTCCAGCAACTTCGGCACCCAGACCTA
CACCTGCAACGTAGATCACAAGCCCAGCAACACCAAGGTGGACAAGACAGTTGA
GCGCAAATGTTGTGTCGAGTGCCCACCGTGCCCAGCACCACCTGTGGCAGGACC
GTCAGTCTTCCTCTTCCCCCCAAAACCCAAGGACACCCTCATGATCTCCCGGACC
CCTGAGGTCACGTGCGTGGTGGTGGACGTGAGCCACGAAGACCCCGAGGTCCAG
TTCAACTGGTACGTGGACGGCGTGGAGGTGCATAATGCCAAGACAAAGCCACGG
GAGGAGCAGTTCAACAGCACGTTCCGTGTGGTCAGCGTCCTCACCGTTGTGCACC
AGGACTGGCTGAACGGCAAGGAGTACAAGTGCAAGGTCTCCAACAAAGGCCTCC
CAGCCCCCATCGAGAAAACCATCTCCAAAACCAAAGGGCAGCCCCGAGAACCAC
AGGTGTACACCCTGCCCCCATCCCGGGAGGAGATGACCAAGAACCAGGTCAGCC
TGACCTGCCTGGTCAAAGGCTTCTACCCCAGCGACATCGCCGTGGAGTGGGAGA
GCAATGGGCAGCCGGAGAACAACTACAAGACCACGCCTCCCATGCTGGACTCCG
ACGGCTCCTTCTTCCTCTACAGCAAGCTCACCGTGGACAAGAGCAGGTGGCAGC
AGGGGAACGTCTTCTCATGCTCCGTGATGCATGAGGCTCTGCACAACCACTACAC
GCAGAAGAGCCTCTCCCTGTCTCCGGGTAAAGGTGGTGGTGGCTCGGGATCCGG
AGGCTCCGGTGGCGGTGGCAGCAACCCAATTTGCAAGGGATGCTTAAGCTGTAG
CAAGGACAACGGATGTTCACGGTGCCAGCAAAAGCTGTTTTTCTTCCTCCGGCGG
GAAGGAATGCGGCAGTACGGCGAATGTCTCCACTCCTGCCCCTCGGGGTATTAC
GGACACCGCGCGCCTGACATGAACCGATGCGCCAGATGCCGGATCGAGAACTGC
GATAGCTGCCGCAGCAAGGACGCCTGCACTAAGTGCAAAGTCGGCTTCTACCTTC
ACCGGGGCAGATGTTTTGACGAATGCCCGGATGGCTTCGCCCCGCTGGAGGAGA
CTATGGAATGCGTGGAG

LP1-10C22 Heavy chain IgG2, RSPO2 (F105R/F109A) polypeptide (SEQ ID NO: 253)

EVQLVESGGDLVKPGGSLKLSCAASGFTFSSYGMSWVRQTPDKRLEWVASISSGGS
YTYYPDSVKGRFTISRDNAQNTLYLQMSSLKSEDTAMYYCVRHEEYGKSGFAYWG
QGTLITVSASTKGPSVFPLAPCSRSTSESTAALGCLVKDYFPEPVTVSWNSGALTSG
VHTFPAVLQSSGLYSLSSVVTVPSSNFGTQTYTCNVDHKPSNTKVDKTVERKCCVEC
PPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTK
GQPREPQVYTLPPSREEMTKNQVSLTCLVKGFYPSDIAVEWESNGQPENNYKTTPPM
LDSDGSFFLYSKLTVDKSRWQQGNVFSCSVMHEALHNHYTQKSLSLSPGKGGGGSG
SGGSGGGGSNPICKGCLSCSKDNGCSRCQQKLFFFLRREGMRQYGECLHSCPSGYYG
HRAPDMNRCARCRIENCDSCRSKDACTKCKVGFYLHRGRCFDECPDGFAPLEETME
CVE

FIG. 11BH

RSPO2 (F105R/F109A), LP1-1N15 Heavy chain IgG1 N297G polynucleotide (SID NO: 254)

AACCCAATTTGCAAGGGATGCTTAAGCTGTAGCAAGGACAACGGATGTTCACGG
TGCCAGCAAAAGCTGTTTTCTTCCTCCGGCGGGAAGGAATGCGGCAGTACGGC
GAATGTCTCCACTCCTGCCCCTCGGGGTATTACGGACACCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGATCCGGAGGCTCCGGTGGCGGTGGCAGCGAGGTCCAGCTGCA
ACAGTCTGGACCTGAGCTGGTGAAGCCTGGGGCTTCAGTGAAGATGTCCTGTAA
GGCTTCTGGATACACATTCACTGACTACTACATGAACTGGGTGAAGCAGAGTCAT
GGAGAGAGCCTTGAGTGGATTGGACGTGTTATTCCTAGCAATGGTGGTACTAACT
ACAACCAGAAGTTCAAGGGCAAGGCCACATTGACAGTAGACAAATCCCTCACCA
CAGCCTACATGCAGCTCAACAGCCTGACATCTGAAGACTCTGCGGTCTATTTCTG
TGCAAGAGGGATGGACTACTGGGGTCCAGGAACCTCAGTCACCGTCTCCAGCGC
TAGCACCAAGGGCCCATCGGTCTTCCCCCTGGCACCCTCCTCCAAGAGCACCTCT
GGGGGCACAGCGGCCCTGGGCTGCCTGGTCAAGGACTACTTCCCCGAACCGGTG
ACGGTGTCGTGGAACTCAGGCGCCCTGACCAGCGGCGTGCACACCTTCCCGGCT
GTCCTACAGTCCTCAGGACTCTACTCCCTCAGCAGCGTGGTGACCGTGCCCTCCA
GCAGCTTGGGCACCCAGACCTACATCTGCAACGTGAATCACAAGCCCAGCAACA
CCAAGGTGGACAAGAAAGTTGAGCCCAAATCTTGTGACAAAACTCACACATGCC
CACCGTGCCCAGCACCTGAACTCCTGGGGGGACCGTCAGTCTTCCTCTTCCCCCC
AAAACCCAAGGACACCCTCATGATCTCCCGGACCCCTGAGGTCACATGCGTGGT
GGTGGACGTGAGCCACGAAGACCCTGAGGTCAAGTTCAACTGGTACGTGGACGG
CGTGGAGGTGCATAATGCCAAGACAAAGCCGCGGGAGGAGCAGTACGGCAGCA
CGTACCGTGTGGTCAGCGTCCTCACCGTCCTGCACCAGGACTGGCTGAATGGCAA
GGAGTACAAGTGCAAGGTCTCCAACAAAGCCCTCCCAGCCCCCATCGAGAAAAC
CATCTCCAAAGCCAAAGGGCAGCCCCGAGAACCACAGGTGTACACCCTGCCCCC
ATCCCGGGAGGAGATGACCAAGAACCAGGTCAGCCTGACCTGCCTGGTCAAAGG
CTTCTATCCCAGCGACATCGCCGTGGAGTGGGAGAGCAATGGGCAGCCGGAGAA
CAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGC
TCCGTGATGCATGAGGCTCTGCACAACCACTACACGCAGAAGAGCCTCTCCCTGT
CTCCGGGTAAA

RSPO2 (F105R/F109A), LP1-1N15 Heavy chain IgG1 N297G polypeptide (SID NO: 255)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GSGGSGGGGSEVQLQQSGPELVKPGASVKMSCKASGYTFTDYYMNWVKQSHGESL
EWIGRVIPSNGGTNYQKFKGKATLTVDKSLTTAYMQLNSLTSEDSAVYFCARGMD
YWGPGTSVTVSSASTKGPSVFPLAPSSKSTSGGTAALGCLVKDYFPEPVTVSWNSGA
LTSGVHTFPAVLQSSGLYSLSSVVTVPSSSLGTQTYICNVNHKPSNTKVDKKVEPKSC
DKTHTCPPCPAPELLGGPSVFLFPPKPKDTLMISRTPEVTCVVVDVSHEDPEVKFNWY
VDGVEVHNAKTKPREEQYGSTYRVVSVLTVLHQDWLNGKEYKCKVSNKALPAPIE
KTISKAKGQPREPQVYTLPPSREEMTKNQVSLTCLVKGFYPSDIAVEWESNGQPENN
YKTTPPVLDSDGSFFLYSKLTVDKSRWQQGNVFSCSVMHEALHNHYTQKSLSLSPG
K

RSPO2 (F105R/F109A), LP1-1P13 Heavy chain IgG1 N297G polynucleotide (SEQ ID NO: 256)

AACCCAATTTGCAAGGGATGCTTAAGCTGTAGCAAGGACAACGGATGTTCACGG
TGCCAGCAAAAGCTGTTTTCTTCCTCCGGCGGGAAGGAATGCGGCAGTACGGC
GAATGTCTCCACTCCTGCCCCTCGGGGTATTACGGACACCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGATCCGGAGGCTCCGGTGGCGGTGGCAGCGAGGTCAACTGCA
GCAGTCTGGACCTGAACTGGTGAAGCCTGGGGCTTCAGTGAAGATATCCTGCAA
GGCTTCTGGTTACTCATTTACTGACTACTTTATGAACTGGGTGAAGCAGAGCCAT
GGAAAGAGCCTTGAGTGGATTGGACGTTTTAATCCTTTCAATGGTCAAACTTTCT
ACAATCAGGAGTTCAAGGGCAAGGCCACATTAACTGTAGACAAATCCTCTAGCA
CCGCCCACATGGAGCTCCGGAGCCTGACATCTGAGGACTCTGCAGTCTATTATTG
TGCAAGAAGAGGAAGGTACGACGTTTACTATGTTCTGGACTACTGGGGTCAAGG
AACCTCAGTCACCGTCTCCAGCGCTAGCACCAAGGGCCCATCGGTCTTCCCCTG
GCACCCTCCTCCAAGAGCACCTCTGGGGGCACAGCGGCCCTGGGCTGCCTGGTC
AAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCA
GCAGCGTGGTGACCGTGCCCTCCAGCAGCTTGGGCACCCAGACCTACATCTGCA
ACGTGAATCACAAGCCCAGCAACACCAAGGTGGACAAGAAAGTTGAGCCCAAAT
CTTGTGACAAAACTCACACATGCCCACCGTGCCCAGCACCTGAACTCCTGGGGG
GACCGTCAGTCTTCCTCTTCCCCCCAAAACCCAAGGACACCCTCATGATCTCCCG
GACCCCTGAGGTCACATGCGTGGTGGTGGACGTGAGCCACGAAGACCCTGAGGT
CAAGTTCAACTGGTACGTGGACGGCGTGGAGGTGCATAATGCCAAGACAAAGCC
GCGGGAGGAGCAGTACGGCAGCACGTACCGTGTGGTCAGCGTCCTCACCGTCCT
GCACCAGGACTGGCTGAATGGCAAGGAGTACAAGTGCAAGGTCTCCAACAAAGC
CCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGT
CAGCCTGACCTGCCTGGTCAAAGGCTTCTATCCCAGCGACATCGCCGTGGAGTGG
GAGAGCAATGGGCAGCCGGAGAACAACTACAAGACCACGCCTCCCGTGCTGGAC
TCCGACGGCTCCTTCTTCCTCTACAGCAAGCTCACCGTGGACAAGAGCAGGTGGC
AGCAGGGGAACGTCTTCTCATGCTCCGTGATGCATGAGGCTCTGCACAACCACTA
CACGCAGAAGAGCCTCTCCCTGTCTCCGGGTAAA

RSPO2 (F105R/F109A), LP1-1P13 Heavy chain IgG1 N297G polypeptide (SEQ ID NO: 257)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GSGGSGGGGSEVQLQQSGPELVKPGASVKISCKASGYSFTDYFMNWVKQSHGKSLE
WIGRFNPFNGQTFYNQEFKGKATLTVDKSSSTAHMELRSLTSEDSAVYYCARRGRY
DVYYVLDYWGQGTSVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHED
PEVKFNWYVDGVEVHNAKTKPREEQYGSTYRVVSVLTVLHQDWLNGKEYKCKVS
NKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQ
KSLSLSPGK

FIG. 11BJ

RSPO2 (F105R/F109A), LP1-2122 Heavy chain IgG1 N297G polynucleotide (SEQ ID NO: 258)

AACCCAATTTGCAAGGGATGCTTAAGCTGTAGCAAGGACAACGGATGTTCACGG
TGCCAGCAAAAGCTGTTTTCTTCCTCCGGCGGGAAGGAATGCGGCAGTACGGC
GAATGTCTCCACTCCTGCCCCTCGGGGTATTACGGACACCGCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGATCCGGAGGCTCCGGTGGCGGTGGCAGCGAGGTCCAACTCGT
AGAATCAGGTGGTGGTTTGGTCAAACCAGGTGGCTCTCGGAAGTTGTCCTGTGCT
GCCTCTGGATTTACATTCAGTGACTACGGTATGCACTGGGTCCGTCAGGCTCCAG
AGAAGGGGCTGGAGTGGGTTGCCTACATTAGTAGTGGCAGTAGTACCATCTACT
ATGCAGACACAGTGAAGGGCCGATTCACCATCTCCAGAGACAATGCCAAGAACA
CCCTGTTCCTACAAATGACCAGTCTAAGGTCTGAGGACACAGCCATGTATTACTG
TTCAAGGAAGGGAGGGTTTGGTGACTACGAGAAAAGCTATGCTATGGACTACTG
GGGTCAAGGAACCTCAGTCACCGTCTCCAGCGCTAGCACCAAGGGCCCATCGGT
CTTCCCCCTGGCACCCTCCTCCAAGAGCACCTCTGGGGGCACAGCGGCCCTGGGC
TGCCTGGTCAAGGACTACTTCCCCGAACCGGTGACGGTGTCGTGGAACTCAGGC
GCCCTGACCAGCGGCGTGCACACCTTCCCGGCTGTCCTACAGTCCTCAGGACTCT
ACTCCCTCAGCAGCGTGGTGACCGTGCCCTCCAGCAGCTTGGGCACCCAGACCTA
CATCTGCAACGTGAATCACAAGCCCAGCAACACCAAGGTGGACAAGAAAGTTGA
GCCCAAATCTTGTGACAAAACTCACACATGCCCACCGTGCCCAGCACCTGAACTC
CTGGGGGGACCGTCAGTCTTCCTCTTCCCCCCAAAACCCAAGGACACCCTCATGA
TCTCCCGGACCCCTGAGGTCACATGCGTGGTGGTGGACGTGAGCCACGAAGACC
CTGAGGTCAAGTTCAACTGGTACGTGGACGGCGTGGAGGTGCATAATGCCAAGA
CAAAGCCGCGGGAGGAGCAGTACGGCAGCACGTACCGTGTGGTCAGCGTCCTCA
CCGTCCTGCACCAGGACTGGCTGAATGGCAAGGAGTACAAGTGCAAGGTCTCCA
ACAAAGCCCTCCCAGCCCCCATCGAGAAAACCATCTCCAAAGCCAAAGGGCAGC
CCCGAGAACCACAGGTGTACACCCTGCCCCCATCCCGGGAGGAGATGACCAAGA
ACCAGGTCAGCCTGACCTGCCTGGTCAAAGGCTTCTATCCCAGCGACATCGCCGT
GGAGTGGGAGAGCAATGGGCAGCCGGAGAACAACTACAAGACCACGCCTCCCG
TGCTGGACTCCGACGGCTCCTTCTTCCTCTACAGCAAGCTCACCGTGGACAAGAG
CAGGTGGCAGCAGGGGAACGTCTTCTCATGCTCCGTGATGCATGAGGCTCTGCAC
AACCACTACACGCAGAAGAGCCTCTCCCTGTCTCCGGGTAAA

RSPO2 (F105R/F109A), LP1-2122 Heavy chain IgG1 N297G polypeptide (SID NO: 259)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GSGGSGGGGSEVQLVESGGGLVKPGGSRKLSCAASGFTFSDYGMHWVRQAPEKGL
EWVAYISSGSSTIYYADTVKGRFTISRDNAKNTLFLQMTSLRSEDTAMYYCSRKGGF
GDYEKSYAMDYWGQGTSVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVS
HEDPEVKFNWYVDGVEVHNAKTKPREEQYGSTYRVVSVLTVLHQDWLNGKEYKC
KVSNKALPAPIEKTISKAKGQPREPQVYTLPPSREEMTKNQVSLTCLVKGFYPSDIAV
EWESNGQPENNYKTTPPVLDSDGSFFLYSKLTVDKSRWQQGNVFSCSVMHEALHNH
YTQKSLSLSPGK

RSPO2 (F105R/F109A), LP1-2I22 Heavy chain IgG1 N297G polynucleotide (SEQ ID NO: 260)

AACCCAATTTGCAAGGGATGCTTAAGCTGTAGCAAGGACAACGGATGTTCACGG
TGCCAGCAAAAGCTGTTTTCTTCCTCCGGCGGGAAGGAATGCGGCAGTACGGC
GAATGTCTCCACTCCTGCCCCTCGGGGTATTACGGACACCGCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGATCCGGAGGCTCCGGTGGCGGTGGCAGCGAGGTCAACTGCA
GCAGTCTGGACCTGAACTGGTGAAGCCTGGGGCTTCAGTGAAGATATCCTGCAA
GGCTTCTGGTTACTCATTTACTGGCTACTTTATGAACTGGGTGAAGCAGAGCCAT
GGAAAGAGCCTTGAGTGGATTGGACGTTTTAATCCTTTCAATGGTCAAACTTTCT
ACAATCAGGAGTTCAAGGGCAAGGCCACATTAACTGTTGACAAATCCTCTGACA
CCGCCCACATGGAACTCCGGAGCCTGACATCTGAGGACTCTGCAGTCTATTATTG
TGCAAGAAGAGGAAGGTACGACGTTTACTATGCTCTGGACTACTGGGGTCAAGG
AACCTCAGTCACCGTCTCCAGCGCTAGCACCAAGGGCCCATCGGTCTTCCCCCTG
GCACCCTCCTCCAAGAGCACCTCTGGGGGCACAGCGGCCCTGGGCTGCCTGGTC
AAGGACTACTTCCCCGAACCGGTGACGGTGTCGTGGAACTCAGGCGCCCTGACC
AGCGGCGTGCACACCTTCCCGGCTGTCCTACAGTCCTCAGGACTCTACTCCCTCA
GCAGCGTGGTGACCGTGCCCTCCAGCAGCTTGGGCACCCAGACCTACATCTGCA
ACGTGAATCACAAGCCCAGCAACACCAAGGTGGACAAGAAAGTTGAGCCCAAAT
CTTGTGACAAAACTCACACATGCCCACCGTGCCCAGCACCTGAACTCCTGGGGG
GACCGTCAGTCTTCCTCTTCCCCCCAAAACCCAAGGACACCCTCATGATCTCCCG
GACCCCTGAGGTCACATGCGTGGTGGTGGACGTGAGCCACGAAGACCCTGAGGT
CAAGTTCAACTGGTACGTGGACGGCGTGGAGGTGCATAATGCCAAGACAAAGCC
GCGGGAGGAGCAGTACGGCAGCACGTACCGTGTGGTCAGCGTCCTCACCGTCCT
GCACCAGGACTGGCTGAATGGCAAGGAGTACAAGTGCAAGGTCTCCAACAAAGC
CCTCCCAGCCCCCATCGAGAAAACCATCTCCAAAGCCAAAGGGCAGCCCCGAGA
ACCACAGGTGTACACCCTGCCCCCATCCCGGGAGGAGATGACCAAGAACCAGGT
CAGCCTGACCTGCCTGGTCAAAGGCTTCTATCCCAGCGACATCGCCGTGGAGTGG
GAGAGCAATGGGCAGCCGGAGAACAACTACAAGACCACGCCTCCCGTGCTGGAC
TCCGACGGCTCCTTCTTCCTCTACAGCAAGCTCACCGTGGACAAGAGCAGGTGGC
AGCAGGGGAACGTCTTCTCATGCTCCGTGATGCATGAGGCTCTGCACAACCACTA
CACGCAGAAGAGCCTCTCCCTGTCTCCGGGTAAA

RSPO2 (F105R/F109A), LP1-2I22 Heavy chain IgG1 N297G polypeptide (SID NO: 261)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GSGGSGGGGSEVQLQQSGPELVKPGASVKISCKASGYSFTGYFMNWVKQSHGKSLE
WIGRFNPFNGQTFYNQEFKGKATLTVDKSSDTAHMELRSLTSEDSAVYYCARRGRY
DVYYALDYWGQGTSVTVSSASTKGPSVFPLAPSSKSTSGGTAALGCLVKDYFPEVT
VSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHED
PEVKFNWYVDGVEVHNAKTKPREEQYGSTYRVVSVLTVLHQDWLNGKEYKCKVS
NKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQ
KSLSLSPGK

FIG. 11BL

RSPO2 (F105R/F109A), LP1-3A24 Heavy chain IgG1 N297G polynucleotide (SEQ ID NO: 262)

AACCCAATTTGCAAGGGATGCTTAAGCTGTAGCAAGGACAACGGATGTTCACGG
TGCCAGCAAAAGCTGTTTTCTTCCTCCGGCGGGAAGGAATGCGGCAGTACGGC
GAATGTCTCCACTCCTGCCCCTCGGGGTATTACGGACACCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGATCCGGAGGCTCCGGTGGCGGTGGCAGCGAGGTCCAGCTGCA
ACAGTCTGGACCTGAGCTGGTGAAGCCTGGGGCTTCAGTGAAGATGTCCTGTAA
GGCTTCTGGATACACATTCACTGACTACTACATAAACTGGGTGAGGCAGAGTCAT
GGAAAGAGCCTTGAGTGGATTGGACGTGTTATTCCTAGCAATGGTGGTAGTAACT
ACAACCAGAAGTTCAAGGGCAAGGCCACATTGACAGTAGACAAATCCCTCAGTA
CAGCCTACATGCACCTCAACAGCCTGACATCTGAGGACTCTGCGGTCTATTACTG
TGCAACCCAGCTGGGACGGTGGGGCCAAGGGACTCTGGTCACTGTCTCTGCAGC
TAGCACCAAGGGCCCATCGGTCTTCCCCCTGGCACCCTCCTCCAAGAGCACCTCT
GGGGGCACAGCGGCCCTGGGCTGCCTGGTCAAGGACTACTTCCCCGAACCGGTG
ACGGTGTCGTGGAACTCAGGCGCCCTGACCAGCGGCGTGCACACCTTCCCGGCT
GTCCTACAGTCCTCAGGACTCTACTCCCTCAGCAGCGTGGTGACCGTGCCCTCCA
GCAGCTTGGGCACCCAGACCTACATCTGCAACGTGAATCACAAGCCCAGCAACA
CCAAGGTGGACAAGAAAGTTGAGCCCAAATCTTGTGACAAAACTCACACATGCC
CACCGTGCCCAGCACCTGAACTCCTGGGGGGACCGTCAGTCTTCCTCTTCCCCCC
AAAACCCAAGGACACCCTCATGATCTCCCGGACCCCTGAGGTCACATGCGTGGT
GGTGGACGTGAGCCACGAAGACCCTGAGGTCAAGTTCAACTGGTACGTGGACGG
CGTGGAGGTGCATAATGCCAAGACAAAGCCGCGGGAGGAGCAGTACGGCAGCA
CGTACCGTGTGGTCAGCGTCCTCACCGTCCTGCACCAGGACTGGCTGAATGGCAA
GGAGTACAAGTGCAAGGTCTCCAACAAAGCCCTCCCAGCCCCCATCGAGAAAAC
CATCTCCAAAGCCAAAGGGCAGCCCCGAGAACCACAGGTGTACACCCTGCCCCC
ATCCCGGGAGGAGATGACCAAGAACCAGGTCAGCCTGACCTGCCTGGTCAAAGG
CTTCTATCCCAGCGACATCGCCGTGGAGTGGGAGAGCAATGGGCAGCCGGAGAA
CAACTACAAGACCACGCCTCCCGTGCTGGACTCCGACGGCTCCTTCTTCCTCTAC
AGCAAGCTCACCGTGGACAAGAGCAGGTGGCAGCAGGGGAACGTCTTCTCATGC
TCCGTGATGCATGAGGCTCTGCACAACCACTACACGCAGAAGAGCCTCTCCCTGT
CTCCGGGTAAA

RSPO2 (F105R/F109A), LP1-3A24 Heavy chain IgG1 N297G polypeptide (SEQ ID NO: 263)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GSGGSGGGGSEVQLQQSGPELVKPGASVKMSCKASGYTFTDYYINWVRQSHGKSLE
WIGRVIPSNGGSNYNQKFKGKATLTVDKSLSTAYMHLNSLTSEDSAVYYCATQLGR
WGQGTLVTVSAASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCD
KTHTCPPCPAPELLGGPSVFLFPPKPKDTLMISRTPEVTCVVVDVSHEDPEVKFNWYV
DGVEVHNAKTKPREEQYGSTYRVVSVLTVLHQDWLNGKEYKCKVSNKALPAPIEK
TISKAKGQPREPQVYTLPPSREEMTKNQVSLTCLVKGFYPSDIAVEWESNGQPENNY
KTTPPVLDSDGSFFLYSKLTVDKSRWQQGNVFSCSVMHEALHNHYTQKSLSLSPGK

FIG. 11BM

RSPO2 (F105R/F109A), LP1-3E20 Heavy chain IgG1 N297G polynucleotide (SEQ ID NO: 264)

AACCCAATTTGCAAGGGATGCTTAAGCTGTAGCAAGGACAACGGATGTTCACGG
TGCCAGCAAAAGCTGTTTTCTTCCTCCGGCGGGAAGGAATGCGGCAGTACGGC
GAATGTCTCCACTCCTGCCCCTCGGGGTATTACGGACACCGCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGATCCGGAGGCTCCGGTGGCGGTGGCAGCCAGGTCCAACTGCA
GCAGTCTGGGGCTGAACTGGCAAAACCTGGGGCCTCAGTGAAGATGTCCTGCAA
GGCTTCTGGCTACACCTTTACTAGCTACTGGATACACTGGGTAAAACAGAGGCCT
GGACAGGGTCTGGAATGGATTGGATACATTAATCCTAGCAGTGGTTATGCTGAGT
ACAATCAGAAGTTCAAGGTCAGGGCCACATTGACTGCAGACAAATCCTCCAGCA
CAGCCTACATGCAACTAAGCAGCCTGACATCTGAGGACTCTGCAGTCTATTACTG
TGCAAGAGAAAGTTACTATAGTTTCGACTATACTATGGACTACTGGGGTCAAGGA
ACCTCAGTCACCGTCTCCAGCGCTAGCACCAAGGGCCCATCGGTCTTCCCCCTGG
CACCCTCCTCCAAGAGCACCTCTGGGGGCACAGCGGCCCTGGGCTGCCTGGTCA
AGGACTACTTCCCCGAACCGGTGACGGTGTCGTGGAACTCAGGCGCCCTGACCA
GCGGCGTGCACACCTTCCCGGCTGTCCTACAGTCCTCAGGACTCTACTCCCTCAG
CAGCGTGGTGACCGTGCCCTCCAGCAGCTTGGGCACCCAGACCTACATCTGCAAC
GTGAATCACAAGCCCAGCAACACCAAGGTGGACAAGAAAGTTGAGCCCAAATCT
TGTGACAAAACTCACACATGCCCACCGTGCCCAGCACCTGAACTCCTGGGGGGA
CCGTCAGTCTTCCTCTTCCCCCCAAAACCCAAGGACACCCTCATGATCTCCCGGA
CCCCTGAGGTCACATGCGTGGTGGTGGACGTGAGCCACGAAGACCCTGAGGTCA
AGTTCAACTGGTACGTGGACGGCGTGGAGGTGCATAATGCCAAGACAAAGCCGC
GGGAGGAGCAGTACGGCAGCACGTACCGTGTGGTCAGCGTCCTCACCGTCCTGC
ACCAGGACTGGCTGAATGGCAAGGAGTACAAGTGCAAGGTCTCCAACAAAGCCC
TCCCAGCCCCCATCGAGAAAACCATCTCCAAAGCCAAAGGGCAGCCCCGAGAAC
CACAGGTGTACACCCTGCCCCCATCCCGGGAGGAGATGACCAAGAACCAGGTCA
GCCTGACCTGCCTGGTCAAAGGCTTCTATCCCAGCGACATCGCCGTGGAGTGGGA
GAGCAATGGGCAGCCGGAGAACAACTACAAGACCACGCCTCCCGTGCTGGACTC
CGACGGCTCCTTCTTCCTCTACAGCAAGCTCACCGTGGACAAGAGCAGGTGGCA
GCAGGGGAACGTCTTCTCATGCTCCGTGATGCATGAGGCTCTGCACAACCACTAC
ACGCAGAAGAGCCTCTCCCTGTCTCCGGGTAAA

RSPO2 (F105R/F109A), LP1-3E20 Heavy chain IgG1 N297G polypeptide (SID NO: 265)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GSGGSGGGGSQVQLQQSGAELAKPGASVKMSCKASGYTFTSYWIHWVKQRPGQGL
EWIGYINPSSGYAEYNQKFKVRATLTADKSSSTAYMQLSSLTSEDSAVYYCARESYY
SFDYTMDYWGQGTSVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHED
PEVKFNWYVDGVEVHNAKTKPREEQYGSTYRVVSVLTVLHQDWLNGKEYKCKVS
NKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQ
KSLSLSPGK

FIG. 11BN

RSPO2 (F105R/F109A), LP1-7B13 Heavy chain IgG1 N297G polynucleotide (SEQ ID NO: 266)

AACCCAATTTGCAAGGGATGCTTAAGCTGTAGCAAGGACAACGGATGTTCACGG
TGCCAGCAAAAGCTGTTTTCTTCCTCCGGCGGGAAGGAATGCGGCAGTACGGC
GAATGTCTCCACTCCTGCCCCTCGGGGTATTACGGACACCGCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGATCCGGAGGCTCCGGTGGCGGTGGCAGCGAGGTCCAGCTGCA
ACAATCTGGACCTGAGGTGGTGAAGCCTGGGGCTTCAGTGAAGATGTCCTGTAA
GACTTCTGGATTCACATTCACTGACTACTACATGAACTGGGTGAAGCAGGGTCAT
GGAAAGAGCCTTGAGTGGATTGGACGTGTTAATCCTAGCAATGATGATACTAGG
TACAATCAGAAGTTCAAGGGAAAGGCCACATTGACAGTAGACAAGTCCCTCAGC
ACAGCCTACATGCAGCTCAACAGCCTGACATCTGAGGACTCTGCGGTCTATTACT
GTACAAGGTGGTTCTACTTTGACTACTGGGGCCAAGGCACTACTCTCACAGTCTC
CAGCGCTAGCACCAAGGGCCCATCGGTCTTCCCCCTGGCACCCTCCTCCAAGAGC
ACCTCTGGGGGCACAGCGGCCCTGGGCTGCCTGGTCAAGGACTACTTCCCCGAA
CCGGTGACGGTGTCGTGGAACTCAGGCGCCCTGACCAGCGGCGTGCACACCTTC
CCGGCTGTCCTACAGTCCTCAGGACTCTACTCCCTCAGCAGCGTGGTGACCGTGC
CCTCCAGCAGCTTGGGCACCCAGACCTACATCTGCAACGTGAATCACAAGCCCA
GCAACACCAAGGTGGACAAGAAAGTTGAGCCCAAATCTTGTGACAAAACTCACA
CATGCCCACCGTGCCCAGCACCTGAACTCCTGGGGGGACCGTCAGTCTTCCTCTT
CCCCCCAAAACCCAAGGACACCCTCATGATCTCCCGGACCCCTGAGGTCACATGC
GTGGTGGTGGACGTGAGCCACGAAGACCCTGAGGTCAAGTTCAACTGGTACGTG
GACGGCGTGGAGGTGCATAATGCCAAGACAAAGCCGCGGGAGGAGCAGTACGG
CAGCACGTACCGTGTGGTCAGCGTCCTCACCGTCCTGCACCAGGACTGGCTGAAT
GGCAAGGAGTACAAGTGCAAGGTCTCCAACAAAGCCCTCCCAGCCCCCATCGAG
AAAACCATCTCCAAAGCCAAAGGGCAGCCCCGAGAACCACAGGTGTACACCCTG
CCCCCATCCCGGGAGGAGATGACCAAGAACCAGGTCAGCCTGACCTGCCTGGTC
AAAGGCTTCTATCCCAGCGACATCGCCGTGGAGTGGGAGAGCAATGGGCAGCCG
GAGAACAACTACAAGACCACGCCTCCCGTGCTGGACTCCGACGGCTCCTTCTTCC
TCTACAGCAAGCTCACCGTGGACAAGAGCAGGTGGCAGCAGGGGAACGTCTTCT
CATGCTCCGTGATGCATGAGGCTCTGCACAACCACTACACGCAGAAGAGCCTCTC
CCTGTCTCCGGGTAAA

RSPO2 (F105R/F109A), LP1-7B13 Heavy chain IgG1 N297G polypeptide (SEQ ID NO: 267)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GSGGSGGGGSEVQLQQSGPEVVKPGASVKMSCKTSGFTFTDYYMNWVKQGHGKSL
EWIGRVNPSNDDTRYNQKFKGKATLTVDKSLSTAYMQLNSLTSEDSAVYYCTRWF
YFDYWGQGTTLTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVDKKVEP
KSCDKTHTCPPCPAPELLGGPSVFLFPPKPKDTLMISRTPEVTCVVVDVSHEDPEVKF
NWYVDGVEVHNAKTKPREEQYGSTYRVVSVLTVLHQDWLNGKEYKCKVSNKALP
APIEKTISKAKGQPREPQVYTLPPSREEMTKNQVSLTCLVKGFYPSDIAVEWESNGQP
ENNYKTTPPVLDSDGSFFLYSKLTVDKSRWQQGNVFSCSVMHEALHNHYTQKSLSL
SPGK

FIG. 11BO

RSPO2 (F105R/F109A), LP1-8M24 Heavy chain IgG1 N297G polynucleotide (SEQ ID NO: 268)

CAGGTTCAGCTGCAGCAGTCTGGAGCTGAGCTGGCGAGGCCTGGGGCTTCAGTG
AAGCTGTCCTGCAAGGCTTCTGGCTACACCTTCACAAATTATGGTATAAACTGGG
TGAAGCAGAGAACTGGACAGGGCCTTGAGTGGATTGGAGAGATTTTTCCTAGAA
GTGATAATACTTTCTACAATGAGAAGTTCAAGGGCAAGGCCACACTGACTGCAG
ACAAATCCTCCACCACAGCGTACATGGAGCTCCGCAGCCTGACATCTGAGGACT
CTGCGGTCTATTTCTGTGCAAGAAAAGGCAGGGACTACGGTACTAGCCACTACTT
TGACTACTGGGGTCAAGGCACCACTCTCACAGTCTCCAGCGCTAGCACCAAGGG
CCCATCGGTCTTCCCCCTGGCACCCTCCTCCAAGAGCACCTCTGGGGGCACAGCG
GCCCTGGGCTGCCTGGTCAAGGACTACTTCCCCGAACCGGTGACGGTGTCGTGGA
ACTCAGGCGCCCTGACCAGCGGCGTGCACACCTTCCCGGCTGTCCTACAGTCCTC
AGGACTCTACTCCCTCAGCAGCGTGGTGACCGTGCCCTCCAGCAGCTTGGGCACC
CAGACCTACATCTGCAACGTGAATCACAAGCCCAGCAACACCAAGGTGGACAAG
AAAGTTGAGCCCAAATCTTGTGGATCCGGCTCCGGACATCATCATCACCATCAC

RSPO2 (F105R/F109A), LP1-8M24 Heavy chain IgG1 N297G polypeptide (SEQ ID NO: 269)

QVQLQQSGAELARPGASVKLSCKASGYTFTNYGINWVKQRTGQGLEWIGEIFPRSD
NTFYNEKFKGKATLTADKSSTTAYMELRSLTSEDSAVYFCARKGRDYGTSHYFDYW
GQGTTLTVSSASTKGPSVFPLAPSSKSTSGGTAALGCLVKDYFPEPVTVSWNSGALTS
GVHTFPAVLQSSGLYSLSSVVTVPSSSLGTQTYICNVNHKPSNTKVDKKVEPKSCGS
GSGHHHHHH

FIG. 11BP

RSPO2 (F105R/F109A), LP1-9M16 Heavy chain IgG1 N297G polynucleotide (SEQ ID NO: 270)

AACCCAATTTGCAAGGGATGCTTAAGCTGTAGCAAGGACAACGGATGTTCACGG
TGCCAGCAAAAGCTGTTTTCTTCCTCCGGCGGGAAGGAATGCGGCAGTACGGC
GAATGTCTCCACTCCTGCCCCTCGGGGTATTACGGACACCGCGCGCCTGACATGA
ACCGATGCGCCAGATGCCGGATCGAGAACTGCGATAGCTGCCGCAGCAAGGACG
CCTGCACTAAGTGCAAAGTCGGCTTCTACCTTCACCGGGGCAGATGTTTTGACGA
ATGCCCGGATGGCTTCGCCCCGCTGGAGGAGACTATGGAATGCGTGGAGGGTGG
TGGTGGCTCGGGATCCGGAGGCTCCGGTGGCGGTGGCAGCGAGGTCCAGCTGCA
ACAGTCTGGACCTGAGCTGGTGAAGCCTGGGGCTTCAGTGAAGATGTCCTGTAA
GGCTTCTGGATACACATTCACTGACTACTACATGAACTGGGTGAAGCAGAGTCAT
GGAAAGAGCCTTGAGTGGATTGGACGTGTTAATCCTAACAATGGTGGTTCTAACT
ACAACCAGAAATTCAAGGGCAAGGCCACATTGACAGTAGACAAATCCCTCAGCA
CAGCCTACATGCAGCTCAACAGCCTGACATCTGAGGACTCTGCGGTCTATTACTG
TGCAAGTCGAAACTTCGATGTCTGGGGCGCAGGGACCACGGTCACCGTCTCCAG
CGCTAGCACCAAGGGCCCATCGGTCTTCCCCCTGGCACCCTCCTCCAAGAGCACC
TCTGGGGGCACAGCGGCCCTGGGCTGCCTGGTCAAGGACTACTTCCCCGAACCG
GTGACGGTGTCGTGGAACTCAGGCGCCCTGACCAGCGGCGTGCACACCTTCCCG
GCTGTCCTACAGTCCTCAGGACTCTACTCCCTCAGCAGCGTGGTGACCGTGCCCT
CCAGCAGCTTGGGCACCCAGACCTACATCTGCAACGTGAATCACAAGCCCAGCA
ACACCAAGGTGGACAAGAAAGTTGAGCCCAAATCTTGTGACAAAACTCACACAT
GCCCACCGTGCCCAGCACCTGAACTCCTGGGGGGACCGTCAGTCTTCCTCTTCCC
CCCAAAACCCAAGGACACCCTCATGATCTCCCGGACCCCTGAGGTCACATGCGT
GGTGGTGGACGTGAGCCACGAAGACCCTGAGGTCAAGTTCAACTGGTACGTGGA
CGGCGTGGAGGTGCATAATGCCAAGACAAAGCCGCGGGAGGAGCAGTACGGCA
GCACGTACCGTGTGGTCAGCGTCCTCACCGTCCTGCACCAGGACTGGCTGAATGG
CAAGGAGTACAAGTGCAAGGTCTCCAACAAAGCCCTCCCAGCCCCCATCGAGAA
AACCATCTCCAAAGCCAAAGGGCAGCCCCGAGAACCACAGGTGTACACCCTGCC
CCCATCCCGGGAGGAGATGACCAAGAACCAGGTCAGCCTGACCTGCCTGGTCAA
AGGCTTCTATCCCAGCGACATCGCCGTGGAGTGGGAGAGCAATGGGCAGCCGGA
GAACAACTACAAGACCACGCCTCCCGTGCTGGACTCCGACGGCTCCTTCTTCCTC
TACAGCAAGCTCACCGTGGACAAGAGCAGGTGGCAGCAGGGGAACGTCTTCTCA
TGCTCCGTGATGCATGAGGCTCTGCACAACCACTACACGCAGAAGAGCCTCTCCC
TGTCTCCGGGTAAA

RSPO2 (F105R/F109A), LP1-9M16 Heavy chain IgG1 N297G polypeptide (SID NO: 271)

NPICKGCLSCSKDNGCSRCQQKLFFFLRREGMRQYGECLHSCPSGYYGHRAPDMNR
CARCRIENCDSCRSKDACTKCKVGFYLHRGRCFDECPDGFAPLEETMECVEGGGGS
GSGGSGGGGSEVQLQQSGPELVKPGASVKMSCKASGYTFTDYYMNWVKQSHGKSL
EWIGRVNPNNGGSNYNQKFKGKATLTVDKSLSTAYMQLNSLTSEDSAVYYCASRNF
DVWGAGTTVTVSSASTKGPSVFPLAPSSKSTSGGTAALGCLVKDYFPEPVTVSWNSG
ALTSGVHTFPAVLQSSGLYSLSSVVTVPSSSLGTQTYICNVNHKPSNTKVDKKVEPKS
CDKTHTCPPCPAPELLGGPSVFLFPPKPKDTLMISRTPEVTCVVVDVSHEDPEVKFNW
YVDGVEVHNAKTKPREEQYGSTYRVVSVLTVLHQDWLNGKEYKCKVSNKALPAPI
EKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSP
GK

FIG. 11BQ

Anti-ASGR1 heavy chain polynucleotide (SEQ ID NO: 272)

GAAGTGCAGCTGCTGGAATCCGGGGGCGGACTGGTGCAACCCGGGGGATCCCTC
AGACTGTCCTGTGCCGCATCGGGTTTCACTTTCTCCTCCTACGCGATGTCATGGGT
CAGACAGGCCCCTGGAAAAGGCCTCGAATGGGTGTCGGCTATCTCCGGATCGGG
GGGATCTACTTACTACGCCGACTCCGTGAAGGGCCGGTTCACTATCTCGAGGGAC
AACTCCAAGAATACCCTGTACTTGCAAATGAACTCCCTGCGCGCCGAGGATACC
GCGGTGTATTACTGCGCCAAGGACTTCAGCTCACGCCGGTGGTACCTTGAGTACT
GGGGACAGGGAACCCTTGTCACCGTGTCGAGTGCTAGCACCAAGGGCCCATCGG
TCTTCCCCCTGGCGCCCTGCTCCAGGAGCACCTCCGAGAGCACAGCGGCCCTGGG
CTGCCTGGTCAAGGACTACTTCCCCGAACCGGTGACGGTGTCGTGGAACTCAGGC
GCTCTGACCAGCGGCGTGCACACCTTCCCAGCTGTCCTACAGTCCTCAGGACTCT
ACTCCCTCAGCAGCGTGGTGACCGTGCCCTCCAGCAACTTCGGCACCCAGACCTA
CACCTGCAACGTAGATCACAAGCCCAGCAACACCAAGGTGGACAAGACAGTTGA
GCGCAAATGTTGTGTCGAGTGCCCACCGTGCCCAGCACCACCTGTGGCAGGACC
GTCAGTCTTCCTCTTCCCCCCAAAACCCAAGGACACCCTCATGATCTCCCGGACC
CCTGAGGTCACGTGCGTGGTGGTGGACGTGAGCCACGAAGACCCCGAGGTCCAG
TTCAACTGGTACGTGGACGGCGTGGAGGTGCATAATGCCAAGACAAAGCCACGG
GAGGAGCAGTTCAACAGCACGTTCCGTGTGGTCAGCGTCCTCACCGTTGTGCACC
AGGACTGGCTGAACGGCAAGGAGTACAAGTGCAAGGTCTCCAACAAAGGCCTCC
CAGCCCCCATCGAGAAAACCATCTCCAAAACCAAAGGGCAGCCCCGAGAACCAC
AGGTGTACACCCTGCCCCCATCCCGGGAGGAGATGACCAAGAACCAGGTCAGCC
TGACCTGCCTGGTCAAAGGCTTCTACCCCAGCGACATCGCCGTGGAGTGGGAGA
GCAATGGGCAGCCGGAGAACAACTACAAGACCACGCCTCCCATGCTGGACTCCG
ACGGCTCCTTCTTCCTCTACAGCAAGCTCACCGTGGACAAGAGCAGGTGGCAGC
AGGGGAACGTCTTCTCATGCTCCGTGATGCATGAGGCTCTGCACAACCACTACAC
GCAGAAGAGCCTCTCCCTGTCTCCGGGTAAA

Anti-ASGR1 heavy chain polypeptide (SEQ ID NO: 273)

EVQLLESGGGLVQPGGSLRLSCAASGFTFSSYAMSWVRQAPGKGLEWVSAISGSGG
STYYADSVKGRFTISRDNSKNTLYLQMNSLRAEDTAVYYCAKDFSSRRWYLEYWG
QGTLVTVSSASTKGPSVFPLAPCSRSTSESTAALGCLVKDYFPEPVTVSWNSGALTSG
VHTFPAVLQSSGLYSLSSVVTVPSSNFGTQTYTCNVDHKPSNTKVDKTVERKCCVEC
PPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTK
GQPREPQVYTLPPSREEMTKNQVSLTCLVKGFYPSDIAVEWESNGQPENNYKTTPPM
LDSDGSFFLYSKLTVDKSRWQQGNVFSCSVMHEALHNHYTQKSLSLSPGK

FIG. 11BR

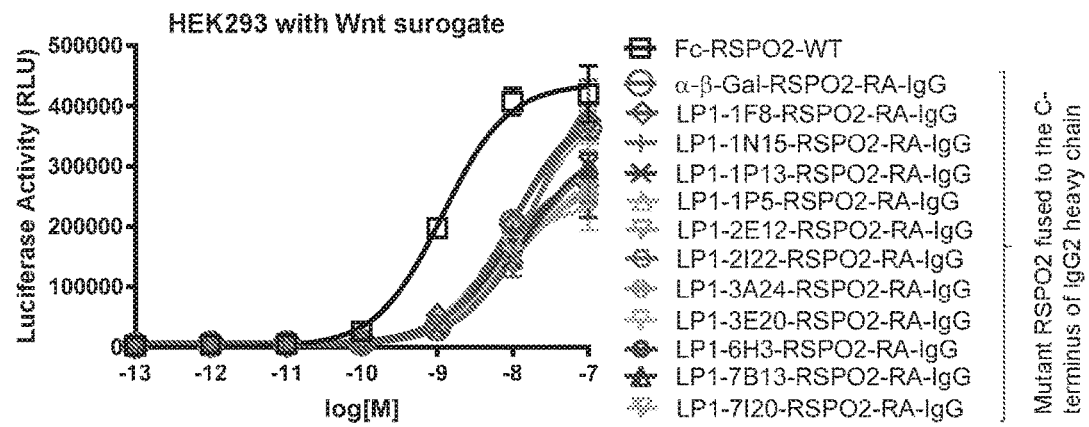
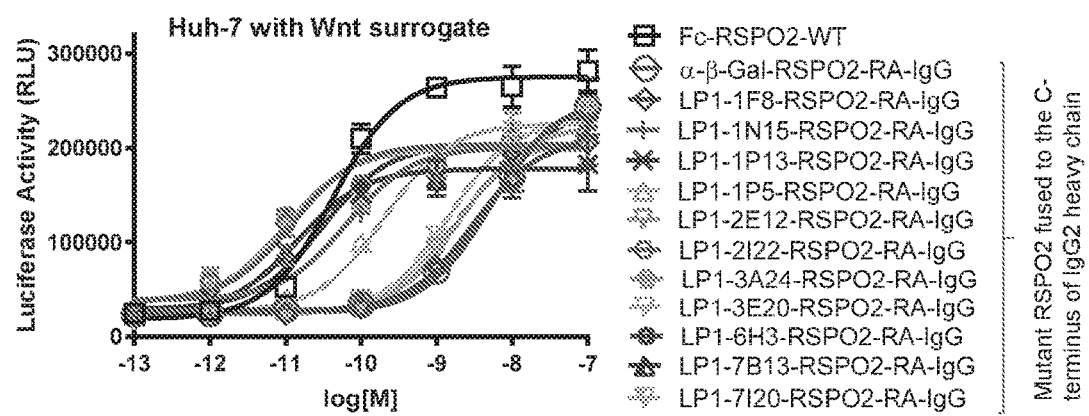
| | HEK293 | | Huh-7 | |
|---|---|---|---|---|
| | % Emax of RSPO | EC50 (M) | % Emax of RSPO | EC50 (M) |
| Fc-RSPO2-WT | 100.0 | 1.2E-09 | 100.0 | 4.2E-11 |
| α-β-Gal-RSPO2-RA-IgG | 91.3 | 9.8E-09 | 92.0 | 5.4E-09 |
| LP1-1F8-RSPO2-RA-IgG | 94.1 | 1.0E-08 | 76.4 | 3.0E-09 |
| LP1-1N15-RSPO2-RA-IgG | 111.5 | 2.2E-08 | 72.8 | 6.5E-11 |
| LP1-1P13-RSPO2-RA-IgG | 78.1 | 1.4E-08 | 64.5 | 1.4E-11 |
| LP1-1P5-RSPO2-RA-IgG | 86.8 | 8.6E-09 | 82.1 | 2.0E-10 |
| LP1-2E12-RSPO2-RA-IgG | 93.7 | 1.5E-08 | 81.2 | 2.0E-09 |
| LP1-2I22-RSPO2-RA-IgG | 74.3 | 1.3E-08 | 74.1 | 1.2E-11 |
| LP1-3A24-RSPO2-RA-IgG | 62.9 | 9.6E-09 | 72.1 | 1.0E-11 |
| LP1-3E20-RSPO2-RA-IgG | 65.5 | 8.9E-09 | 84.0 | 1.4E-09 |
| LP1-6H3-RSPO2-RA-IgG | 59.9 | 5.0E-09 | 88.7 | 4.8E-09 |
| LP1-7B13-RSPO2-RA-IgG | 69.1 | 7.8E-09 | 74.0 | 3.1E-11 |
| LP1-7I20-RSPO2-RA-IgG | 54.6 | 4.6E-09 | 76.2 | 1.7E-09 |
FIG. 14A

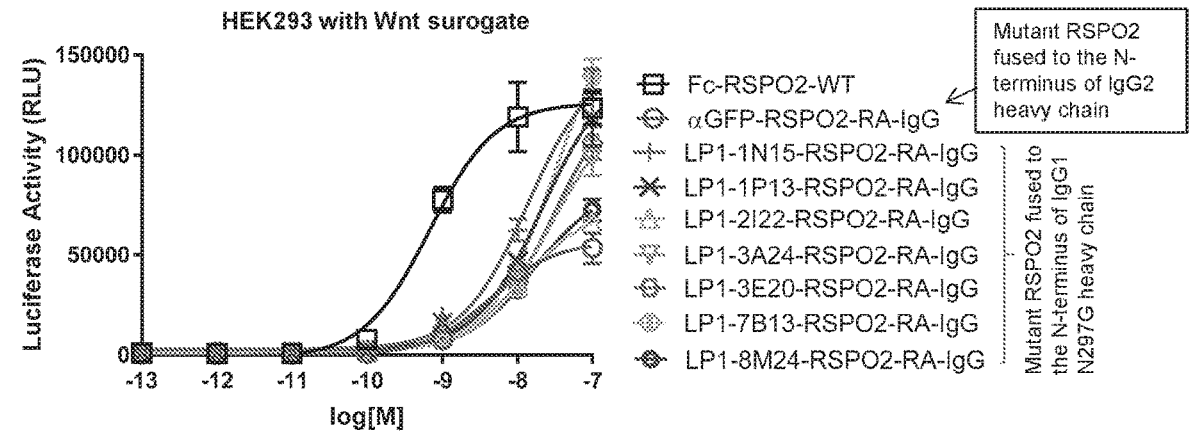
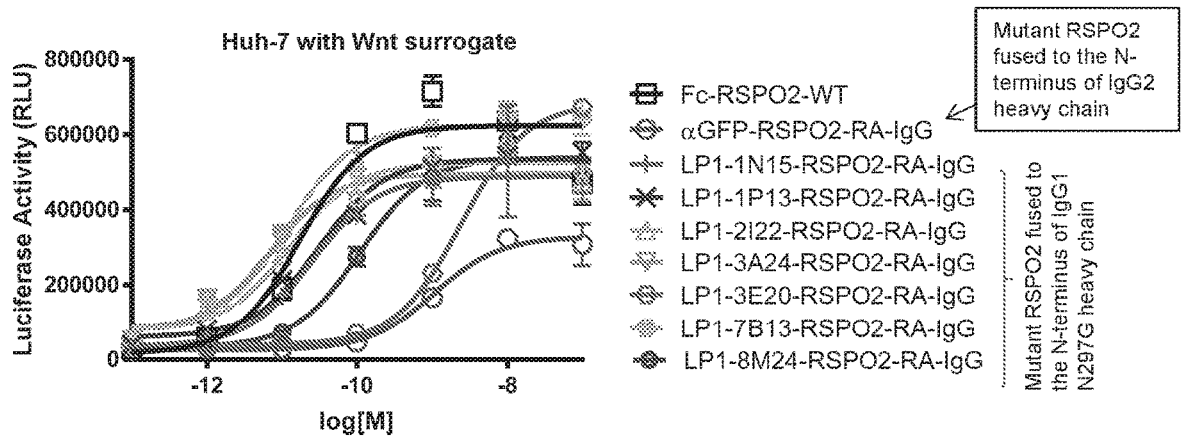
|  | HEK293 | | Huh-7 | |
|---|---|---|---|---|
|  | % Emax of RSPO | EC50 (M) | % Emax of RSPO | EC50 (M) |
| Fc-RSPO2-WT | 144.7 | 6.752E-10 | 100.9 | 1.8E-11 |
| αGFP-RSPO2-RA-IgG | 65.3 | 4.399E-09 | 53.1 | 1.1E-09 |
| LP1-1N15-RSPO2-RA-IgG | 169.0 | 1.346E-08 | 78.9 | 2.5E-11 |
| LP1-1P13-RSPO2-RA-IgG | 163.3 | 2.056E-08 | 86.4 | 3.1E-11 |
| LP1-2I22-RSPO2-RA-IgG | 84.4 | 1.14E-08 | 84.7 | 1.3E-11 |
| LP1-3A24-RSPO2-RA-IgG | 141.0 | 2.49E-08 | 80.1 | 6.6E-12 |
| LP1-3E20-RSPO2-RA-IgG | 156.7 | 2.912E-08 | 110.5 | 2.4E-09 |
| LP1-7B13-RSPO2-RA-IgG | 210.1 | 3.202E-08 | 101.0 | 1.2E-11 |
| LP1-8M24-RSPO2-RA-IgG | 96.5 | 1.631E-08 | 87.0 | 1.1E-10 |
FIG. 14C

| SEQ ID NOs | Common Name | Dose mg/kg | # mice |
|---|---|---|---|
| 155, 156, 159, 160 | α-β-Gal | 5 | 3 |
| 29, 30, 272, 273 | αASGR1-IgG | 5 | 3 |
| 25-28 | αGFP-RSPO2-RA-IgG NG | 5 | 3 |
| 29 - 32 | αASGR1-RSPO2-RA-IgG | 5 | 3 |
| 194, 195, 254, 255 | LP1-1N15-RSPO2-RA-IgG | 5 | 3 |
| 198, 199, 256, 257 | LP1-1P13-RSPO2-RA-IgG | 5 | 3 |
| 210, 211, 258, 259 | LP1-2I13-RSPO2-RA-IgG | 5 | 2 |
| 214, 215, 260, 261 | LP1-2I22-RSPO2-RA-IgG | 5 | 3 |
| 218, 219, 262, 263 | LP1-3A24-RSPO2-RA-IgG | 5 | 2 |
| 222, 223, 264, 265 | LP1-3E20-RSPO2-RA-IgG | 5 | 3 |
| 230, 231, 266, 267 | LP1-7B13-RSPO2-RA-IgG | 5 | 2 |
| 238, 239, 268, 269 | LP1-8M24-RSPO2-RA-IgG | 5 | 3 |
| 246, 247, 270, 271 | LP1-9M16-RSPO2-RA-IgG | 5 | 2 |

TISSUE-SPECIFIC WNT SIGNAL ENHANCING MOLECULES AND USES

CROSS REFERENCE TO RELATED APPLICATIONS

This application is a National Stage application under 35 U.S.C. § 371 of International Application No. PCT/US2019/041067, filed Jul. 9, 2019, which claims priority to U.S. Provisional Application No. 62/695,509, filed on Jul. 9, 2018, U.S. Provisional Application No. 62/770,026, filed on Nov. 20, 2018, and U.S. Provisional Application No. 62/822,731, filed on Mar. 22, 2019, each of which is incorporated by reference herein in its entirety.

STATEMENT REGARDING SEQUENCE LISTING

The Sequence Listing associated with this application is provided in text format in lieu of a paper copy, and is hereby incorporated by reference into the specification. The name of the text file containing the Sequence Listing is SRZN_010_03WO_ST25.txt. The text file is 661 KB, was created on Jul. 9, 2019, and is being submitted electronically via EFS-Web.

FIELD OF THE INVENTION

The present disclosure relates to tissue-specific Wnt signal enhancing molecules, e.g., fusion proteins, comprising a domain that binds an E3 ubiquitin ligase, ZNRF3 or RNF43, and a tissue-specific cell surface receptor binding domain, as well as related methods of using the tissue-specific Wnt signal enhancing molecules to mediate tissue-specific internalization or sequestration of the E3 ligases, ZNRF3/RNF43, thus stabilizing Wnt receptors and enhancing Wnt signaling in a tissue-specific manner, and to treat and prevent a variety of diseases and disorders.

BACKGROUND OF THE INVENTION

Wnt ("Wingless-related integration site" or "Wingless and Int-1" or "Wingless-Int") ligands and their signals play key roles in the control of development, homeostasis and regeneration of many essential organs and tissues, including bone, liver, skin, stomach, intestine, kidney, central nervous system, mammary gland, oral mucosa, taste bud, ovary, cochlea and many other tissues (reviewed, e.g., by Clevers, Loh, and Nusse, 2014; 346:1248012). Modulation of Wnt signaling pathways has potential for treatment of degenerative diseases and tissue injuries. To achieve this goal, it is desirous to develop strategies to modulate Wnt signaling activity in a tissue-specific or cell type-specific manner to avoid unwanted effects. One of the challenges for modulating Wnt signaling as a therapeutic is the existence of multiple Wnt ligands and Wnt receptors, Frizzled 1-10 (Fzd1-10), with many tissues expressing multiple and overlapping Fzds. Canonical Wnt signals also involve Low-density lipoprotein (LDL) receptor-related protein 5 (LRP5) or Low-density lipoprotein (LDL) receptor-related protein 6 (LRP6) as co-receptors, which are broadly expressed in various tissues, in addition to Fzds.

R-spondins 1-4 are a family of ligands that amplify Wnt signals. Each of the R-spondins work through a receptor complex that contains Zinc and Ring Finger 3 (ZNRF3) or Ring Finger Protein 43 (RNF43) on one end and a Leucine-rich repeat-containing G-protein coupled receptor 4-6 (LGR4-6) on the other (reviewed, e.g., by Knight and Hankenson 2014, Matrix Biology; 37: 157-161). R-spondins might also work through additional mechanisms of action. ZNRF3 and RNF43 are two membrane-bound E3 ligases specifically targeting Wnt receptors (Fzd1-10 and LRP5 or LRP6) for degradation. Binding of an R-spondin to ZNRF3/RNF43 and LGR4-6 causes clearance or sequestration of the ternary complex, which removes E3 ligases from Wnt receptors and stabilizes Wnt receptors, resulting in enhanced Wnt signals. Each R-spondin contains two Furin domains (1 and 2), with Furin domain 1 binding to ZNRF3/RNF43, and Furin domain 2 binding to LGR4-6. Fragments of R-spondins containing Furin domains 1 and 2 are sufficient for amplifying Wnt signaling. While R-spondin effects depend on Wnt signals, since both LGR4-6 and ZNRF3/RNF43 are widely expressed in various tissues, the effects of R-spondins are not tissue-specific.

There is clearly a need in the art for tissue-specific Wnt signal enhancing molecules for the treatment and prevention of specific diseases and disorders. The present invention addresses this need by providing compositions and methods useful for enhancing Wnt activity in a tissue-specific manner.

SUMMARY OF THE INVENTION

The present invention relates to tissue-specific Wnt signal enhancing molecules and uses thereof, e.g., in increasing Wnt signaling in a target tissue and treating disease and conditions that would benefit from increased Wnt signaling. In particular embodiments, the tissue is liver.

In one embodiment, the present invention provides a tissue-specific Wnt signal enhancing molecule, or a pharmaceutically acceptable salt thereof, comprising a first domain that specifically binds one or more transmembrane E3 ubiquitin ligases selected from ZNRF3 and RNF43, and a second domain that specifically binds a tissue-specific cell surface molecule, wherein the molecule increases Wnt signaling in the tissue. In certain embodiments, the Wnt signal enhancing molecule is liver-specific, and the second domain specifically binds a liver-specific cell surface molecule and increases Wnt signaling in the liver or liver cells. In various embodiments, either or both of the first domain and the second domain are polypeptides, antibodies, small molecules, natural ligands, non-natural ligands, or variants thereof.

In particular embodiments of Wnt signal enhancing molecules, the first domain comprises a first polypeptide sequence and/or the second domain comprises a second polypeptide sequence. In particular embodiments, the molecule is a fusion protein comprising the first polypeptide sequence and the second polypeptide sequence. In certain embodiments, the first polypeptide sequence comprises an R-Spondin sequence or a fragment or variant thereof. In particular embodiments, the R-spondin is an R-spondin-1, an R-spondin-2, an R-spondin-3, or an R-spondin-4, e.g., a human R-spondin-1-4. In certain embodiments, the first polypeptide suquence comprises an R-spondin Furin domain 1 or a fragment or variant thereof. In particular embodiments, the first polypeptide sequence is a wild-type R-spondin-derived sequence or a modified sequence. In addition, the first polypeptide sequence could have increased, similar, or reduced binding to LGR4-6 as compared to the corresponding native full length R-spondin. In some embodiments, the the R-spondin or the R-spondin Furin domain 1 has at least 50%, at least 60%, at least 70%, at least 80%, at least 90%, or at least 95% identity to any of the R-spondins or R-spondin Furin 1 domains present in SEQ ID NOs:1-4. In certain embodiments, the first polypeptide is an antibody or antigen-binding fragment thereof that specifically binds ZNRF3 and/or RNF43. In particular embodiments, the first polypeptide is an antibody or an antigen-binding fragment thereof, comprising: a) CDRH1, CDRH2 and CDRH3 sequences set forth for any of the antibodies of Table 2A; and/or b) CDRL1, CDRL2 and CDRL3 sequences set forth for any of the antibodies of Table 2A, or a variant of said antibody, or antigen-binding fragment thereof, comprising one or more amino acid modifications, wherein said variant comprises less than 8 amino acid substitutions in said CDR sequences. In particular embodiments, the first polypeptide is an antibody or an antigen-binding fragment thereof, comprising a nanobody, VH or VL sequence set forth in Table 2B or SEQ ID NOs:78-150 or 165-170, or a fragment or variant thereof.

In certain embodiments, the second polypeptide sequence is polypeptide, an antibody or fragment or variant thereof, or a ligand or fragment or variant thereof. In certain embodiments, the second polypeptide is an antibody or antigen-binding fragment thereof that specifically binds ASGR1 and/or ASGR2. In particular embodiments, the second polypeptide is an antibody or an antigen-binding fragment thereof, comprising: a) CDRH1, CDRH2 and CDRH3 sequences set forth for any of the antibodies of Table 3A; and/or b) CDRL1, CDRL2 and CDRL3 sequences set forth for any of the antibodies of Table 3A, or a variant of said antibody, or antigen-binding fragment thereof, comprising one or more amino acid modifications, wherein said variant comprises less than 8 amino acid substitutions in said CDR sequences. In particular embodiments, the first polypeptide is an antibody or an antigen-binding fragment thereof, comprising a nanobody, VH or VL sequence set forth in Table 3B or SEQ ID NOs:47-77, 151-154, 171-179, or 274-305, or a fragment or variant thereof.

In certain illustrative embodiments of the tissue-specific Wnt signal enhancing molecules disclosed herein: the tissue is bone tissue, and the cell surface receptor is parathyroid hormone receptor 1 (PTH1R); the tissue is liver tissue, and the cell surface receptor is asialoglycoprotein receptor 1 (ASGR1), asialoglycoprotein receptor 2 (ASGR2), transferrin receptor 2 (TFR2) or solute carrier family 10 member 1 (SLC10A1); or the tissue is oral mucous tissue, and the cell surface receptor is LY6/PLAUR Domain Containing 3 (LYPD3) or Desmoglein 3 (DSG3). In particular embodiments, the second polypeptide is an antibody or an antigen-binding fragment thereof, comprising a nanobody, VH or VL sequence set forth in Table 3C or SEQ ID NOs:180-186, or a fragment or variant thereof.

In certain illustrative embodiments of the tissue-specific Wnt signal enhancing molecules disclosed herein: the cell surface molecule is a PTH1, and the second polypeptide sequence specifically binds PTH1R; the cell surface molecule is ASGR1, and the second polypeptide sequence specifically binds ASGR1; the cell surface molecule is ASGR2, and the second polypeptide sequence specifically binds ASGR2; the cell surface molecule is SLC10A1, and the second polypeptide sequence specifically binds SLC10A1; the cell surface molecule is TFR2, and the second polypeptide sequence specifically binds TFR2; the cell surface molecule is LYPD3, and the second polypeptide sequence specifically binds LYPD3; or the cell surface molecule is DSG3, and the second polypeptide sequence specifically binds DSG3, wherein the second polypeptide is an antibody or fragment thereof, a small molecule, or a ligand, or fragment or variant thereof, of the cell surface molecule.

In particular embodiments of the tissue-specific Wnt signal enhancing molecules described herein, the first domain and the second domain are joined by a linker moiety. In certain embodiments, the linker moiety is a peptidyl linker sequence. In particular embodiments, the peptidyl linker sequence comprises one or more amino acids selected from the group consisting of: Glycine, Asparagine, Serine, Threonine and Alanine In particular embodiments, the tissue-specific Wnt signal enhancing molecules described herein consist of a single polypeptide, e.g., a fusion protein comprising the first domain and the second domain. In certain embodiments, the tissue-specific Wnt signal enhancing molecules described herein comprise two or more polypeptides, such as dimers or multimers comprising two or more fusion proteins, each comprising the first domain and the second domain, wherein the two or more polypeptides are linked, e.g., through a linker moiety or via a bond between amino acid residues in each of the two or more polypepitdes, e.g., an intermolecular disulfide bond between cysteine residues. In particular embodiments, the tissue-specific Wnt signal enhancing molecules described herein comprise two or more polypeptide sequences. For example, a tissue-specific Wnt signal enhancing molecule may comprise antibody heavy and light chains (or antigen-binding fragments thereof) that constitute either the first domain or the second domain, wherein the other domain (i.e., the second domain or first domain) is linked to the antibody heavy chain or light chain, either as a fusion protein or via a linker moiety. In particular embodiments, the other domain is linked to the N-terminus of the heavy chain, the C-terminus of the heavy chain, the N-terminus of the light chain, or the C-terminus of the light chain. Such structures may be referred to herein as appended IgG scaffolds or formats.

In a related embodiment, the present invention includes a nucleic acid sequence encoding for a tissue-specific Wnt signal enhancing fusion protein disclosed herein or a subunit thereof, e.g., an antibody heavy chain or light chain having an appended or fused first domain or second domain. In a further related embodiment, the present invention includes a vector comprising the nucleic acid sequence. In some embodiments, the vector is an expression vector comprising a promoter sequence operatively linked to the nucleic acid sequence, e.g., in a manner suitable for expression in bacterial or eukaryotic cells. In another embodiment, the vector is engineered for in vitro translation and modification of functional mRNA. In a further related embodiment, the present invention includes a host cell comprising the vector. In yet another further related embodiment, the present invention includes a process for producing a tissue-specific Wnt signal enhancing fusion protein described herein, comprising culturing the host cell under conditions wherein the fusion polypeptide is expressed by the expression vector. In some embodiments, the process further comprises the step of isolating the fusion polypeptide that is produced.

In another embodiment, the present invention provides a pharmaceutical composition comprising a tissue-specific Wnt signal enhancing molecule described herein, or a pharmaceutically acceptable salt thereof, and a pharmaceutically acceptable diluent, adjuvant or carrier.

In another embodiment, the present invention provides a pharmaceutical composition comprising a polynucleotide comprising a nucleic acid sequence encoding a tissue-specific Wnt signal enhancing molecule described herein, or a pharmaceutically acceptable salt thereof, and a pharmaceutically acceptable diluent, adjuvant or carrier. In particular embodiments, the nucleic acid sequence comprises DNA or mRNA, optionally a modified mRNA.

In another embodiment, the present invention provides a pharmaceutical composition comprising a vector comprising a nucleic acid sequence encoding a tissue-specific Wnt signal enhancing molecule, or a pharmaceutically acceptable salt thereof, and a pharmaceutically acceptable diluent, adjuvant or carrier. In particular embodiments, the vector comprises a promoter operatively linked to the nucleic acid sequence, which drives expression of the tissue-specific Wnt signal enhancing molecule. In certain embodiments, the vector is an expression vector or a viral vector.

In another embodiment, the present invention provides a pharmaceutical composition comprising: a tissue-specific Wnt signal enhancing molecule described herein, or a pharmaceutically acceptable salt thereof; a Wnt polypeptide, a Norrin polypeptide, or a Wnt signaling agonist, or a pharmaceutically acceptable salt thereof and a pharmaceutically acceptable diluent, adjuvant or carrier.

In another embodiment, the present invention provides a pharmaceutical composition comprising: a polynucleotide comprising a nucleic acid sequence encoding a tissue-specific Wnt signal enhancing molecule described herein, or a pharmaceutically acceptable salt thereof a polynucleotide comprising a nucleic acid sequence encoding a Wnt polypeptide, a Norrin polypeptide, or a Wnt signaling agonist, or a pharmaceutically acceptable salt thereof; and a pharmaceutically acceptable diluent, adjuvant or carrier. In particular embodiments, the nucleic acid sequence comprises DNA or mRNA, optionally a modified mRNA.

In another embodiment, the present invention provides a pharmaceutical composition comprising: a vector comprising a nucleic acid sequence encoding a tissue-specific Wnt signal enhancing molecule, or a pharmaceutically acceptable salt thereof; a vector comprising a nucleic acid sequence encoding a Wnt polypeptide, a Norrin polypeptide, or a Wnt signaling agonist, or a pharmaceutically acceptable salt thereof; and a pharmaceutically acceptable diluent, adjuvant or carrier. In particular embodiments, the vector comprises a promoter operatively linked to the nucleic acid sequence, which drives expression of the tissue-specific Wnt signal enhancing molecule. In certain embodiments, the vector is an expression vector or a viral vector.

In a further embodiment, the present invention includes a method for increasing Wnt signaling in a target tissue, comprising contacting the target tissue with a tissue-specific Wnt signal enhancing molecule described herein, wherein the second domain specifically binds a cell-specific surface molecule on the target tissue, and wherein the tissue-specific Wnt signal enhancing molecule binds the target tissue and sequesters or increases endocytosis of one or more transmembrane E3 ubiquitin ligase selected from ZNRF3 and RNF43 in the target tissue.

In certain embodiments of any of the methods described herein: the tissue is bone tissue, and the cell surface molecule is PTH1R; the tissue is liver tissue, and the cell surface molecule is ASGR1, ASGR2, TFR2, or SLC10A1; or the tissue is oral mucous tissue and the cell surface receptor is LYPD3 or DSG3. In particular embodiments, the target tissue or cell is contacted with a polynucleotide comprising a nucleic acid sequence encoding the tissue-specific Wnt signal enhancing molecule, or a vector comprising a nucleic acid sequence encoding the tissue-specific Wnt signal enhancing molecule, e.g., an expression vector or viral vector.

In a further embodiment, the present invention includes a method for increasing Wnt signaling in a target tissue, comprising contacting the target tissue with: a tissue-specific Wnt signal enhancing molecule described herein, wherein the second domain specifically binds a cell-specific surface molecule on the target tissue, and wherein the tissue-specific Wnt signal enhancing molecule binds the target tissue and sequesters or increases endocytosis of one or more transmembrane E3 ubiquitin ligase selected from ZNRF3 and RNF43 in the target tissue, and a Wnt polypeptide, a Norrin polypeptide, or a Wnt signaling agonist, or a pharmaceutically acceptable salt thereof. In particular embodiments, the target tissue or cell is contacted with a polynucleotide comprising a nucleic acid sequence encoding the tissue-specific Wnt signal enhancing molecule and a nucleic acid encoding the Wnt polypeptide, a Norrin polypeptide, or a Wnt signaling agonist. In other embodiments, the target tissue or cell is contacted with a vector comprising a nucleic acid sequence encoding the tissue-specific Wnt signal enhancing molecule and a vector encoding the Wnt polypeptide, a Norrin polypeptide, or a Wnt signaling agonist.

In yet another related embodiment, the present invention includes a method for treating or preventing a disease or condition in a subject in need thereof, wherein the disease or condition is associated with reduced Wnt signaling or would benefit from increased Wnt signaling, comprising providing to the subject an effective amount of a pharmaceutical composition comprising the tissue-specific Wnt signal enhancing molecule, or a pharmaceutically acceptable salt thereof, either alone or in combination with a Wnt, Norrin, or a Wnt activating/mimetic molecule. In particular embodiments, the method is performed using a pharmaceutical composition comprising a polynucleotide comprising a nucleic acid sequence encoding the tissue-specific Wnt signal enhancing molecule (e.g., a DNA or mRNA), or a vector comprising a nucleic acid sequence encoding the tissue-specific Wnt signal enhancing molecule (e.g., an expression vector or viral vector), alone or in combination with a pharmaceutical composition comprising a polynucleotide comprising a nucleic acid sequence encoding the Wnt polypeptide, a Norrin polypeptide, or a Wnt signaling agonist molecule (e.g., a DNA or mRNA), or a vector comprising a nucleic acid sequence encoding the Wnt polypeptide, a Norrin polypeptide, or a Wnt signaling agonist molecule (e.g., an expression vector or viral vector).

In particular embodiments of any of the methods of treatment described herein, the disease or disorder is a liver disease or disorder of a tissue selected from the group consisting of: acute liver failure of all causes, acute liver failure drug-induced, alcoholic liver diseases, chronic liver failure of all causes, cirrhosis, liver fibrosis of all causes, portal hypertension, chronic liver insufficiency of all causes, end stage liver disease (ESLD), nonalcoholic steatohepatitis (NASH), nonalcoholic fatty liver disease (NAFLD) (fatty liver), alcoholic hepatitis, hepatitis C virus-induced liver diseases (HCV), hepatitis B virus-induced liver diseases (HBV), other viral hepatitis (e.g., hepatitis A virus-induced liver diseases (HAV) and hepatitis D virus-induced liver diseases (HDV)), primary biliary cirrhosis, autoimmune hepatitis, livery surgery, liver injury, liver transplantation, "small for size" syndrome in liver surgery and transplantation, congenital liver disease and disorders, any other liver disorder or detect resulting from genetic diseases, degeneration, aging, drugs, or injuries. In particular embodiments of any of the methods of treatment or prevention described herein, the pharmaceutical composition is provided systemically, parenterally, orally, intramuscularly, locally, or topically. In particular embodiments, the subject is a mammal, optionally a human.

In another embodiments, the disclosure provides an isolated antibody, or an antigen-binding fragment thereof, that binds to a RNF43 or a ZNRF3 polypeptide, comprising a sequence comprising: (i) CDRH1, CDRH2 and CDRH3 sequences set forth for any of the antibodies of Table 2A; and/or (ii) CDRL1, CDRL2 and CDRL3 sequences set forth for any of the antibodies of Table 2A, or a variant of said antibody, or antigen-binding fragment thereof, comprising one or more amino acid modifications, wherein said variant comprises less than 8 amino acid substitutions in said CDR sequences. In certain embodiments, the antibody or antigen-binding fragment thereof comprises a heavy chain variable region comprising an amino acid sequence having at least 90% identity to an amino acid sequence set forth in Table 2B or SEQ ID NOs:78-150 or 165-170, or a heavy chain variable region comprising an amino acid sequence set forth in Table 2B or SEQ ID NOs:78-150 or 165-170. In particular embodiments, the antibody, or antigen-binding fragment thereof comprises a light chain variable region comprising an amino acid sequence having at least 90% identity to the amino acid sequence set forth in Table 2B or SEQ ID NOs:78-150 or 165-170, or a light chain variable region comprising the amino acid sequence set forth in Table 2B or SEQ ID NOs:78-150 or 165-170.

In another embodiment, the disclosure provides an isolated antibody, or an antigen-binding fragment thereof, that binds to an ASGR1 or ASGR2 polypeptide, comprising a sequence comprising: (i) CDRH1, CDRH2 and CDRH3 sequences set forth for any of the antibodies of Table 3A; and/or (ii) CDRL1, CDRL2 and CDRL3 sequences set forth for any of the antibodies of Table 3A, or a variant of said antibody, or antigen-binding fragment thereof, comprising one or more amino acid modifications, wherein said variant comprises less than 8 amino acid substitutions in said CDR sequences. In certain embodiments, the antibody or antigen-binding fragment thereof comprises a heavy chain variable region comprising an amino acid sequence having at least 90% identity to an amino acid sequence set forth in Table 3B or SEQ ID NOs 47-77, 151-154, 171-179 or 274-305, or a heavy chain variable region comprising an amino acid sequence set forth in Table 3B or SEQ ID NOs 47-77, 151-154, 171-179 or 274-305. In certain embodiments, the antibody, or antigen-binding fragment thereof comprises a light chain variable region comprising an amino acid sequence having at least 90% identity to the amino acid sequence set forth in Table 3B or SEQ ID NOs:47-77, 151-154, 171-179 or 274-305, or a light chain variable region comprising the amino acid sequence set forth in Table 3B or SEQ ID NOs:47-77, 151-154, 171-179 or 274-305.

In particular embodiments, the antibody or antigen-binding fragment thereof comprises a heavy chain variable region or light chain variable region comprising an amino acid sequence having at least 90% identity to an amino acid sequence set forth in Table 3C or SEQ ID NOs:180-185, or a fragment or variant thereof.

The present disclosure also provides antibodies and antigen-binding fragments thereof that compete for binding with any of the antibodies or antigen binding fragments thereof disclosed herein.

In a related embodiment, the disclosure provides a pharmaceutical composition comprising any of the antibodies or antigen-binding fragments thereof disclosed herein.

In a further embodiment, the disclosure provides a method for increasing liver to body weight ratio, promoting liver regeneration, increasing liver cell proliferation or mitosis, decreasing liver fibrosis, optionally following a chronic liver injury, increasing hepatocyte function, or decreasing coagulation time in liver, comprising providing to a subject in need thereof an effective amount of a pharmaceutical composition comprising an antibody or antigen-binding fragment thereof disclosed herein that binds to an ASGR1 or ASGR2 polypeptide.

BRIEF DESCRIPTION OF THE DRAWINGS

Features of the disclosure are set forth with particularity in the appended claims. A better understanding of the features and advantages of the present invention will be obtained by reference to the following detailed description that sets forth illustrative embodiments, in which the principles of the invention are utilized, and the accompanying drawings.

FIGS. 1A-1D. Design of tissue-specific Wnt signaling enhancer molecules. (FIG. 1A) Alignment of all four human R-spondin proteins (Rspo1 (SEQ ID NO:1); Rspo2 (SEQ ID NO:2); Rspo3 (SEQ ID NO:3); and Rspo4 (SEQ ID NO:4), with the Furin domain 1 (Fu1) and 2 (Fu2) shaded in light and dark shading, respectively. The Fu1 domain generally corresponds to: about amino acid residues 38-94 of SEQ ID NO:1; about amino acid residues 37-93 of SEQ ID NO:2; about amino acid residues 39-95 of SEQ ID NO:3; and about amino acid residues 32-88 of SEQ ID NO:4. The Fu2 domain generally corresponds to: about amino acid residues 97-144 of SEQ ID NO:1; about amino acid residues 96-143 of SEQ ID NO:2; about amino acid residues 98-144 of SEQ ID NO:3; and about amino acid residues 91-137 of SEQ ID NO:4. (FIG. 1B) Scheme of illustrative designed molecules. Fragments of RSPO2 spanning the Fu1 and Fu2 domains (action module) were fused to the C-terminus of scFv antibodies (targeting module) to generate the constructs shown in FIG. 1B, which correspond to the poynucleotide and polypeptide sequences set forth in SEQ ID NO:5-16. Specific mutations in the Fu1 and Fu2 domains are indicated. (FIG. 1C) Bio-layer interferometry analysis of LGR5 binding to the anti-GFP series and anti-ASGR1 series of fusion proteins, as indicated. Entire steps of the binding assay with 111 nM of RSPO2-derived fusion proteins are shown on top. The binding response composed of association and dissociation phases are separately shown in the inserted boxes. The average responses between 140 to 145 seconds of association phase from 7 different concentrations were analyzed by steady-state analysis to determine $K_D$ values (bottom). (FIG. 1D) Analysis of binding of the indicated constructs to RNF43 and ZNRF3, as indicated (SEQ ID NOs: 43-46).

(FIG. 2A) Semi-quantitative PCR analysis of ASGR1, and ASGR2 (top) and TFRC (bottom) gene expression level in HEK293, Huh-7 and A431 cells (shown left to right for each gene). The signals were normalized to ACTB. (FIG. 2B) SuperTop Flash (STF) reporter activity of specified proteins (SEQ ID NO:5-16) in HEK293 (upper graphs) or Huh-7 (lower graphs), in the presence (left graphs) or absence (right graphs) of exogenous Wnt sources (30% Wnt3a conditioned media). (FIG. 2C) Western Blot analysis on LRP6 receptor and DVL2 phosphorylation in Huh-7 cells. Asterisk indicates a non-specific band that is detected in Huh-7 by the antibody used. The lower bands indicated by the arrow correspond to DVL2 with and without phosphorylation. Tubulin (TUB) is used as the loading control.

(FIG. 3A) STF activity in HEK293 cells transiently transfected with TFRC (encoding transferrin receptor TFR1 as the control, top), ASGR1 (middle), and ASGR1 together with ASGR2 (bottom), either in the presence (left) or absence (right) of exogenous Wnt source (30% Wnt3a conditioned media). (FIG. 3B) STF activity in A431 cells with TFRC or ASGR1 over expression as specified. (FIG. 3C) Flow cytometry analysis of cell surface level of Fzd proteins. HEK293 cells were transiently transfected with either ZNRF3 alone (top) or ASGR1 and ZNRF3 (bottom), treated with fusion proteins as specified at 10 nM, then stained by the pan-Fzd antibody 18R5.

FIGS. 4A-4E. Validation of the mechanism with another molecule targeting a different receptor, TFR1. (FIG. 4A) LGR5 binding of the anti-TFR1 series of fusion constructs (SEQ ID NOs:17-22) by Bio-layer interferometry analysis. Entire steps of the binding assay with 111 nM of RSPO2-derived fusion proteins are shown on top. The binding response composed of association and dissociation phases are separately shown in the inserted box. The average responses between 140 to 145 seconds of association phase from 7 different concentrations were analyzed by steady-state analysis to determine $K_D$ values (bottom). (FIG. 4B) Analysis of binding of the anti-TFR1 series of fusion constructs to RNF43 (left) and ZNRF3 (right), with steady state-fitting analyses for αTFR-RSPO2, αTFR-RSPO2-RA and αTFR-RPOS-5mut from left to right in the lower graphs. (FIG. 4C) STF activity of specified proteins on HEK293 (top) or Huh-7 (bottom) in the presence (left) or absence (right) exogenous Wnt source (30% Wnt3a conditioned media). (FIG. 4D) Western Blot analysis on LRP6 receptor and DVL2 phosphorylation in HEK293 cells. Tubulin (TUB) is used as the loading control. (FIG. 4E) Flow cytometry analysis of cell surface level of Fzd proteins following treatment with fusion proteins or controls. HEK293 cells were transiently transfected with ZNRF3, treated with fusion proteins as specified at 10 nM, and then stained by the pan-Fzd antibody 18R5.

(FIG. 5A) STF activity of the targeted Wnt signal enhancing molecule in the IgG format (SEQ ID NOs: 23-34), in HEK293 (top) or Huh-7 (bottom), in the presence (left) or absence (right) of exogenous Wnt sources (30% Wnt3a conditioned media). (FIG. 5B) Study design. (FIG. 5C) Liver and (FIG. 5D) small intestine expression of Axin2, 8 hours after i.p. injection of α-GFP-IgG (SEQ ID NOs:25-26 and 33-34), Fc-RSPO2-WT (SEQ ID NOs: 23-24), αGFP-RSPO2-RA-IgG (SEQ ID NOs: 25-28) or αASGR1-RSPO2-RA-IgG (SEQ ID NOs: 29-31) (n=8 mice per group). Statistical analysis was performed using 1-way ANOVA: (ns) not significant, (*) p<0.05, () p<0.01, (*) p<0.001.

FIGS. 6A-6E. Liver specific induction of proliferation marker, Ki-67 by the hepatocyte-specific Wnt signal enhancing molecules (SEQ ID NOs: 25-34). (FIG. 6A) Study design. (FIG. 6B) Semi-quantitative PCR analysis of Liver expression of Mki67, 48 hours after treatment as specified (n=10 mice per group). (FIG. 6C) Average number of Ki-67+ parenchymal cell nuclei in livers per field of view under 10x objective after treatment. Statistical analysis was performed using 1-way ANOVA: () p<0.01, (**) p<0.0001. (FIG. 6D) Representative images of liver sections stained for Ki67 protein. (FIG. 6E) Semi-quantitative PCR analysis of Mki67 expression in small intestine.

FIGS. 7A-7C. Examples of characterization of binders against hASGR1/2. (FIG. 7A) Bio-layer interferometry analysis of hASGR1 binding of three Fab antibodies (0245-D03, -E03, and -A04; SEQ ID NOs: 47-52), identified by phage display. On top are sensorgrams, and on the bottom are steady-state fitting analyses to determine the $K_D$. (FIG. 7B) Binding of two Fabs against hASGR2 from hybridoma development (ABV-3D11 and -10B8; SEQ ID NOs:151-154). (FIG. 7C) Binding of two Fabs against hASGR1 from hybridoma development (LP1-2I13 and LP1-8M24; SEQ ID NOs:284-285 and 298-299).

FIGS. 9A-9D. Dose titration of a liver-specific Wnt signaling enhancer in naïve healthy mice. (FIG. 9A) Biolyer interferometry analysis of cross-species reactivity of the ASGR1 antibody used to construct αASGR1-RSPO2-RA-IgG (expressed as a Fab, SEQ ID NOs: 29-30 and 161-162). Human and mouse ASGR1 ECDs (SEQ ID NOs: 35-36 and 163-164) were used. Kd determined by curve model fitting was indicated. (FIG. 9B) Axin2 and (FIG. 9C) Ki67 expression in liver (upper panel) and small intestine (lower panel) were analyzed by semi-quantitative PCR, 48 hours after i.p. injection of proteins as specified (n=8 mice per group). Statistical analysis was performed using 1-way ANOVA: (ns) not significant, (*) p<0.05, () p<0.01, (*) p<0.001. (FIG. 9D) Immunohistochemistry staining of liver samples from 10 mg/kg treatment groups. Anti-β-galactosidase (α-β-Gal-IgG, SEQ ID NOs: 155-158) was a neutral antibody used as a control. SEQ ID NOs of other tested proteins are as described in FIG. 5 legends.

(FIG. 10A) Semi-quantitative PCR analysis of Wnt ligands, and Rspo genes in normal and TAA treated mice. (FIG. 10B) Study design. (FIG. 10C) Semi-quantitative PCR analysis of Axin2 (left) and Ki67 (right) gene expression in liver (upper) and small intestine (bottom). (n=10 mice per group). (FIG. 10D) International Normalized Ratio (INR) of prothrombin time during treatment. Statistical analysis was performed using 1-way ANOVA: () p<0.01, (**) p<0.0001 (n=10 mice per group). Anti-β-galactosidase (α-β-Gal-IgG, SEQ ID NOs: 155-156 and 159-160) was a neutral antibody used as a control. SEQ ID NOs of other tested proteins are as described in FIG. 5 legends.

FIGS. 11A-11BR. Sequences of Wnt signal enhancers components.

FIG. 13 is a graph showing Sirius red staining of collagen in mouse livers following two weeks of protein treatment as indicated. * represents the statistical significance (p<0.05) of αASGR-1-RSPO2-RA-IgG vs. αeGFP-mutRSPO2;  represents the statististical significance of Fc-RSPO2-WT vs. αeGFP-mutRSPO2; * represents the statistical significance of αASGR-1-RSPO2-RA-IgG vs. αβgal; **** represents the statistical significance of Fc-RSPO2-WT vs. αβgal.

FIGS. 14A-14D. In vitro hepatocyte-specific activity of RSPO mimetic molecules constructed with internally hybridoma-derived ASGR1 binders. Fusion proteins (SEQ ID NO:190-271) were constructed by joining mutant RSPO2 to the C-terminus of IgG2 heavy chain (FIG. 14A and FIG. 14B), or the N-terminus of IgG1 (N297G) heavy chain (FIG. 14C and FIG. 14D) of the ASGR1 binders. Purified proteins were tesed for their SuperTop Flash (STF) reporter activity in HEK293 (upper graphs) or Huh-7 (lower graphs), in the presence of exogenous Wnt surrogate molecules (100 pM R2M3-26, described in WO2019126398). Controls used are: Fc-RSPO2-WT (SEQ ID NOs: 23-24), αGFP-RSPO2-RA-IgG (RSPO2 appended to the N-terminus of heavy chain, SEQ ID NOs: 25-28; or RSPO2 appended to the C-terminus of heavy chain, SEQ ID NOs: 25-26 and 188-189) or α-β-Gal-RSPO2-RA-IgG (RSPO2 appended to the C-terminus of heavy chain, SEQ ID NOs: 155-156 and 186-187). In each panel a table was provided summarizing the EC50 and Emax comparing with the Fc-RSPO positive control.

DETAILED DESCRIPTION OF THE INVENTION

Figure 1B:
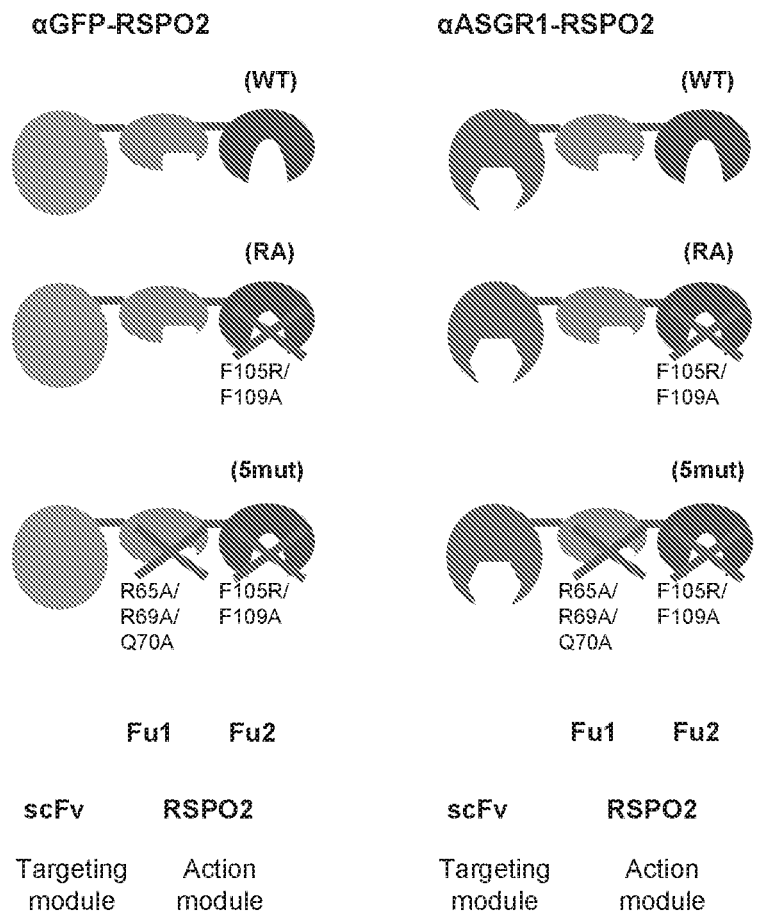

The present disclosure provides tissue-specific Wnt signal enhancing molecules, where in certain embodiments, the molecules: 1) selectively bind to a tissue- or cell-specific cell surface receptor; 2) mediate internalization or sequestration of ZNRF3/RNF43 in the targeted tissue or cell type; and/or 3) enhance Wnt signaling in a tissue-specific manner. In certain embodiments, the molecules are fusion proteins. In certain embodiments, the molecules are antibodies having an additional appended binding domain. Also provided are pharmaceutical compositions and methods for the use of any of the compositions disclosed herein for enhancing, i.e., increasing, Wnt signaling in a targeted tissue or cell type, e.g., for the treatment or prophylaxis of a disease or disorder. In particular embodiments, the molecules bind liver tissue and may be used to increase Wnt signaling in liver tissue or liver cells. These and other objects, advantages, and features of the invention will become apparent to those persons skilled in the art upon reading the details of the compositions and methods as more fully described below.

Definitions

A "vector" as used herein refers to a macromolecule or association of macromolecules that comprises or associates with a polynucleotide and which can be used to mediate delivery of the polynucleotide to a cell. Illustrative vectors include, for example, plasmids, viral vectors, liposomes, and other gene delivery vehicles.

The term "polynucleotide" refers to a polymeric form of nucleotides of any length, including deoxyribonucleotides or ribonucleotides, or analogs thereof. A polynucleotide may comprise modified nucleotides, such as methylated nucleotides and nucleotide analogs, and may be interrupted by non-nucleotide components. If present, modifications to the nucleotide structure may be imparted before or after assembly of the polymer. The term polynucleotide, as used herein, refers interchangeably to double- and single-stranded molecules. Unless otherwise specified or required, any embodiment of the invention described herein that is a polynucleotide encompasses both the double-stranded form and each of two complementary single-stranded forms known or predicted to make up the double-stranded form.

A polynucleotide or polypeptide has a certain percent "sequence identity" to another polynucleotide or polypeptide, meaning that, when aligned, that percentage of bases or amino acids are the same when comparing the two sequences. Sequence similarity can be determined in a number of different manners. To determine sequence identity, sequences can be aligned using the methods and computer programs, including BLAST, available over the world-wide web at ncbi.nlm.nih.gov/BLAST/. Another alignment algorithm is FASTA, available in the Genetics Computing Group (GCG) package, from Madison, Wis., USA, a wholly owned subsidiary of Oxford Molecular Group, Inc. Other techniques for alignment are described in Methods in Enzymology, vol. 266: Computer Methods for Macromolecular Sequence Analysis (1996), ed. Doolittle, Academic Press, Inc., a division of Harcourt Brace & Co., San Diego, Calif., USA. Of particular interest are alignment programs that permit gaps in the sequence. The Smith-Waterman is one type of algorithm that permits gaps in sequence alignments. See Meth. Mol. Biol. 70: 173-187 (1997). Also, the GAP program using the Needleman and Wunsch alignment method can be utilized to align sequences. See J. Mol. Biol. 48: 443-453 (1970)

Of interest is the BestFit program using the local homology algorithm of Smith and Waterman (Advances in Applied Mathematics 2: 482-489 (1981) to determine sequence identity. The gap generation penalty will generally range from 1 to 5, usually 2 to 4 and in many embodiments will be 3. The gap extension penalty will generally range from about 0.01 to 0.20 and in many instances will be 0.10. The program has default parameters determined by the sequences inputted to be compared. Preferably, the sequence identity is determined using the default parameters determined by the program. This program is available also from Genetics Computing Group (GCG) package, from Madison, Wis., USA.

Another program of interest is the FastDB algorithm. FastDB is described in Current Methods in Sequence Comparison and Analysis, Macromolecule Sequencing and Synthesis, Selected Methods and Applications, pp. 127-149, 1988, Alan R. Liss, Inc. Percent sequence identity is calculated by FastDB based upon the following parameters: Mismatch Penalty: 1.00; Gap Penalty: 1.00; Gap Size Penalty: 0.33; and Joining Penalty: 30.0.

"Recombinant," as applied to a polynucleotide means that the polynucleotide is the product of various combinations of cloning, restriction or ligation steps, and other procedures that result in a construct that is distinct from a polynucleotide found in nature.

A "control element" or "control sequence" is a nucleotide sequence involved in an interaction of molecules that contributes to the functional regulation of a polynucleotide, including replication, duplication, transcription, splicing, translation, or degradation of the polynucleotide. The regulation may affect the frequency, speed, or specificity of the process, and may be enhancing or inhibitory in nature. Control elements known in the art include, for example, transcriptional regulatory sequences such as promoters and enhancers. A promoter is a DNA region capable under certain conditions of binding RNA polymerase and initiating transcription of a coding region usually located downstream (in the 3' direction) from the promoter.

"Operatively linked" or "operably linked" refers to a juxtaposition of genetic elements, wherein the elements are in a relationship permitting them to operate in the expected manner. For instance, a promoter is operatively linked to a coding region if the promoter helps initiate transcription of the coding sequence. There may be intervening residues between the promoter and coding region so long as this functional relationship is maintained.

An "expression vector" is a vector comprising a region which encodes a gene product of interest, and is used for effecting the expression of the gene product in an intended target cell. An expression vector also comprises control elements operatively linked to the encoding region to facilitate expression of the gene product in the target. The combination of control elements and a gene or genes to which they are operably linked for expression is sometimes referred to as an "expression cassette," a large number of which are known and available in the art or can be readily constructed from components that are available in the art.

As used herein, the terms "polypeptide," "peptide," and "protein" refer to polymers of amino acids of any length. The terms also encompass an amino acid polymer that has been modified; for example, to include disulfide bond formation, glycosylation, lipidation, phosphorylation, or conjugation with a labeling component.

As used herein, the term "antibody" means an isolated or recombinant binding agent that comprises the necessary variable region sequences to specifically bind an antigenic epitope. Therefore, an antibody is any form of antibody or fragment thereof that exhibits the desired biological activity, e.g., binding the specific target antigen. Thus, it is used in the broadest sense and specifically covers monoclonal antibodies (including full-length monoclonal antibodies), polyclonal antibodies, human antibodies, humanized antibodies, chimeric antibodies, nanobodies, diabodies, multispecific antibodies (e.g., bispecific antibodies), and antibody fragments including but not limited to scFv, Fab, and $Fab_2$, so long as they exhibit the desired biological activity.

"Antibody fragments" comprise a portion of an intact antibody, for example, the antigen-binding or variable region of the intact antibody. Examples of antibody fragments include Fab, Fab', $F(ab')_2$, and Fv fragments; diabodies; linear antibodies (e.g., Zapata et al., Protein Eng. 8(10): 1057-1062 (1995)); single-chain antibody molecules (e.g., scFv); and multispecific antibodies formed from antibody fragments. Papain digestion of antibodies produces two identical antigen-binding fragments, called "Fab" fragments, each with a single antigen-binding site, and a residual "Fc" fragment, a designation reflecting the ability to crystallize readily. Pepsin treatment yields an $F(ab')_2$ fragment that has two antigen combining sites and is still capable of cross-linking antigen.

By "comprising," it is meant that the recited elements are required in, for example, the composition, method, kit, etc., but other elements may be included to form the, for example, composition, method, kit etc. within the scope of the claim. For example, an expression cassette "comprising" a gene encoding a therapeutic polypeptide operably linked to a promoter is an expression cassette that may include other elements in addition to the gene and promoter, e.g. polyadenylation sequence, enhancer elements, other genes, linker domains, etc.

By "consisting essentially of," it is meant a limitation of the scope of the, for example, composition, method, kit, etc., described to the specified materials or steps that do not materially affect the basic and novel characteristic(s) of the, for example, composition, method, kit, etc. For example, an expression cassette "consisting essentially of" a gene encoding a therapeutic polypeptide operably linked to a promoter and a polyadenylation sequence may include additional sequences, e.g. linker sequences, so long as they do not materially affect the transcription or translation of the gene. As another example, a variant, or mutant, polypeptide fragment "consisting essentially of" a recited sequence has the amino acid sequence of the recited sequence plus or minus about 10 amino acid residues at the boundaries of the sequence based upon the full length naïve polypeptide from which it was derived, e.g. 10, 9, 8, 7, 6, 5, 4, 3, 2 or 1 residue less than the recited bounding amino acid residue, or 1, 2, 3, 4, 5, 6, 7, 8, 9, or 10 residues more than the recited bounding amino acid residue.

By "consisting of," it is meant the exclusion from the composition, method, or kit of any element, step, or ingredient not specified in the claim. For example, a polypeptide or polypeptide domain "consisting of" a recited sequence contains only the recited sequence.

An "expression vector" as used herein encompasses a vector, e.g. plasmid, minicircle, viral vector, liposome, and the like as discussed herein or as known in the art, comprising a polynucleotide which encodes a gene product of interest, and is used for effecting the expression of a gene product in an intended target cell. An expression vector also comprises control elements operatively linked to the encoding region to facilitate expression of the gene product in the target. The combination of control elements, e.g. promoters, enhancers, UTRs, miRNA targeting sequences, etc., and a gene or genes to which they are operably linked for expression is sometimes referred to as an "expression cassette." Many such control elements are known and available in the art or can be readily constructed from components that are available in the art.

A "promoter" as used herein encompasses a DNA sequence that directs the binding of RNA polymerase and thereby promotes RNA synthesis, i.e., a minimal sequence sufficient to direct transcription. Promoters and corresponding protein or polypeptide expression may be ubiquitous, meaning strongly active in a wide range of cells, tissues and species or cell-type specific, tissue-specific, or species specific. Promoters may be "constitutive," meaning continually active, or "inducible," meaning the promoter can be activated or deactivated by the presence or absence of biotic or abiotic factors. Also included in the nucleic acid constructs or vectors of the invention are enhancer sequences that may or may not be contiguous with the promoter sequence. Enhancer sequences influence promoter-dependent gene expression and may be located in the 5' or 3' regions of the native gene.

The term "native" or "wild-type" as used herein refers to a nucleotide sequence, e.g. gene, or gene product, e.g. RNA or protein, that is present in a wild-type cell, tissue, organ or organism. The term "variant" as used herein refers to a mutant of a reference polynucleotide or polypeptide sequence, for example a native polynucleotide or polypeptide sequence, i.e. having less than 100% sequence identity with the reference polynucleotide or polypeptide sequence. Put another way, a variant comprises at least one amino acid difference (e.g., amino acid substitution, amino acid insertion, amino acid deletion) relative to a reference polynucleotide sequence, e.g. a native polynucleotide or polypeptide sequence. For example, a variant may be a polynucleotide having a sequence identity of 50% or more, 60% or more, or 70% or more with a full length native polynucleotide sequence, e.g. an identity of 75% or 80% or more, such as 85%, 90%, or 95% or more, for example, 98% or 99% identity with the full length native polynucleotide sequence. As another example, a variant may be a polypeptide having a sequence identity of 70% or more with a full length native polypeptide sequence, e.g. an identity of 75% or 80% or more, such as 85%, 90%, or 95% or more, for example, 98% or 99% identity with the full length native polypeptide sequence. Variants may also include variant fragments of a reference, e.g. native, sequence sharing a sequence identity of 70% or more with a fragment of the reference, e.g. native, sequence, e.g. an identity of 75% or 80% or more, such as 85%, 90%, or 95% or more, for example, 98% or 99% identity with the native sequence.

As used herein, the terms "biological activity" and "biologically active" refer to the activity attributed to a particular biological element in a cell. For example, the "biological activity" of an R-spondin, or fragment or variant thereof refers to the ability to enhance Wnt signals. As another example, the biological activity of a polypeptide or functional fragment or variant thereof refers to the ability of the polypeptide or functional fragment or variant thereof to carry out its native functions of, e.g., binding, enzymatic activity, etc. As a third example, the biological activity of a gene regulatory element, e.g. promoter, enhancer, Kozak sequence, and the like, refers to the ability of the regulatory element or functional fragment or variant thereof to regulate, i.e. promote, enhance, or activate the translation of, respectively, the expression of the gene to which it is operably linked.

The terms "administering" or "introducing" or "providing", as used herein, refer to delivery of a composition to a cell, to cells, tissues and/or organs of a subject, or to a subject. Such administering or introducing may take place in vivo, in vitro or ex vivo.

The terms "treatment", "treating" and the like are used herein to generally mean obtaining a desired pharmacologic and/or physiologic effect. The effect may be prophylactic in terms of completely or partially preventing a disease or symptom thereof, e.g. reducing the likelihood that the disease or symptom thereof occurs in the subject, and/or may be therapeutic in terms of a partial or complete cure for a disease and/or adverse effect attributable to the disease. "Treatment" as used herein covers any treatment of a disease in a mammal, and includes: (a) preventing the disease from occurring in a subject which may be predisposed to the disease but has not yet been diagnosed as having it; (b) inhibiting the disease, i.e., arresting its development; or (c) relieving the disease, i.e., causing regression of the disease. The therapeutic agent may be administered before, during or after the onset of disease or injury. The treatment of ongoing disease, where the treatment stabilizes or reduces the undesirable clinical symptoms of the patient, is of particular interest. Such treatment is desirably performed prior to complete loss of function in the affected tissues. The subject therapy will desirably be administered during the symptomatic stage of the disease, and in some cases after the symptomatic stage of the disease.

The terms "individual," "host," "subject," and "patient" are used interchangeably herein, and refer to a mammal, including, but not limited to, human and non-human primates, including simians and humans; mammalian sport animals (e.g., horses); mammalian farm animals (e.g., sheep, goats, etc.); mammalian pets (dogs, cats, etc.); and rodents (e.g., mice, rats, etc.).

The various compositions and methods of the invention are described below. Although particular compositions and methods are exemplified herein, it is understood that any of a number of alternative compositions and methods are applicable and suitable for use in practicing the invention. It will also be understood that an evaluation of the expression constructs and methods of the invention may be carried out using procedures standard in the art.

The practice of the present invention will employ, unless otherwise indicated, conventional techniques of cell biology, molecular biology (including recombinant techniques), microbiology, biochemistry and immunology, which are within the scope of those of skill in the art. Such techniques are explained fully in the literature, such as, "Molecular Cloning: A Laboratory Manual", second edition (Sambrook et al., 1989); "Oligonucleotide Synthesis" (M. J. Gait, ed., 1984); "Animal Cell Culture" (R. I. Freshney, ed., 1987); "Methods in Enzymology" (Academic Press, Inc.); "Handbook of Experimental Immunology" (D. M. Weir & C. C. Blackwell, eds.); "Gene Transfer Vectors for Mammalian Cells" (J. M. Miller & M. P. Calos, eds., 1987); "Current Protocols in Molecular Biology" (F. M. Ausubel et al., eds., 1987); "PCR: The Polymerase Chain Reaction", (Mullis et al., eds., 1994); and "Current Protocols in Immunology" (J. E. Coligan et al., eds., 1991), each of which is expressly incorporated by reference herein.

Several aspects of the invention are described below with reference to example applications for illustration. It should be understood that numerous specific details, relationships, and methods are set forth to provide a full understanding of the invention. One having ordinary skill in the relevant art, however, will readily recognize that the invention can be practiced without one or more of the specific details or with other methods. The present invention is not limited by the illustrated ordering of acts or events, as some acts may occur in different orders and/or concurrently with other acts or events. Furthermore, not all illustrated acts or events are required to implement a methodology in accordance with the present invention.

The terminology used herein is for the purpose of describing particular embodiments only and is not intended to be limiting of the invention. As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising".

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5-fold, and more preferably within 2-fold, of a value. Where particular values are described in the application and claims, unless otherwise stated the term "about" meaning within an acceptable error range for the particular value should be assumed.

All publications mentioned herein are incorporated herein by reference to disclose and describe the methods and/or materials in connection with which the publications are cited. It is understood that the present disclosure supersedes any disclosure of an incorporated publication to the extent there is a contradiction.

It is further noted that the claims may be drafted to exclude any optional element. As such, this statement is intended to serve as antecedent basis for use of such exclusive terminology as "solely", "only" and the like in connection with the recitation of claim elements, or the use of a "negative" limitation.

Unless otherwise indicated, all terms used herein have the same meaning as they would to one skilled in the art and the practice of the present invention will employ, conventional techniques of microbiology and recombinant DNA technology, which are within the knowledge of those of skill of the art.

Tissue-Specific Wnt Signal Enhancing Molecules

In certain aspects, the present disclosure provides novel tissue-specific Wnt signal enhancing molecules capable of enhancing Wnt activity in a tissue- or cell-specific manner. In certain embodiments, the tissue-specific Wnt signal enhancing molecules are bi-functional molecules comprising a first domain that binds to one or more ZNRF3 and/or RNF43 ligases, and a second domain that binds to one or more targeted tissue or cell type in a tissue- or cell-specific manner. Each of the first domain and the second domain may be any moiety capable of binding to the ligase complex or targeted tissue or cell, respectively. For example, each of the first domain and the second domain may be, but are not limited to, a moiety selected from: a polypeptide (e.g., an antibody or antigen-binding fragment thereof or a peptide or polypeptide different from an antibody), a small molecule, and a natural ligand or a variant, fragment or derivative thereof. In certain embodiments, the natural ligand is a polypeptide, a small molecule, an ion, an amino acid, a lipid, or a sugar molecule. The first domain and the second domain may be the same type of moiety as each other, or they may be different types of moieties. In certain embodiments, the tissue-specific Wnt signal enhancing molecules bind to a tissue- or cell-specific cell surface receptor. In particular embodiments, the tissue-specific Wnt signal enhancing molecules increase or enhance Wnt signaling by at least 50%, at least two-fold, at least three-fold, at least five-fold, at least ten-fold, at least twenty-fold, at least thirty-fold, at least forty-fold, or at least fifty-fold, e.g., as compared to a negative control.

Figure 8:
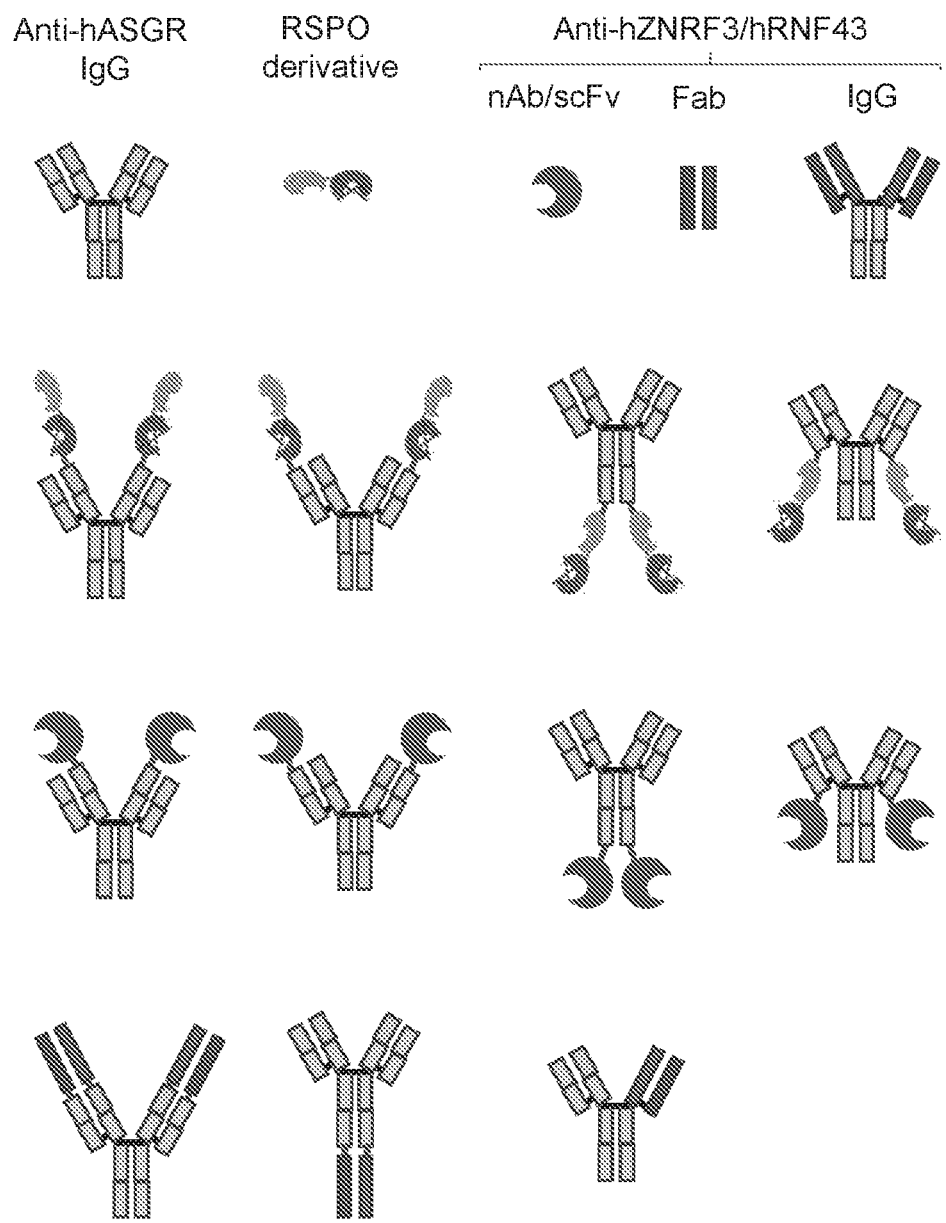
FIG. 8. Scheme of illustrative liver-specific Wnt signaling enhancers. In certain embodiments, the targeting module may be an IgG antibody against hASGR1 or hASGR2, and/or the action module can be RSPO derivatives with wild type or mutated activities. RSPO derivatives can be appended to different positions of the IgG (N- or C-termini of light or heavy chain). In certain configurations, the activation domain can be antibodies or antigen-binding fragments thereof that bind to human ZNRF3/RNF43, e.g., in the form of nanobodies (nAbs), single chain variable regions (scFvs), Fab fragments, or full IgGs. Unlike nAbs and scFv, Fabs contains two polypeptide chains, both of which may be attached to the targeting module, e.g., covalently. Hybrid IgGs are another optional configuration, which contain one Fab as the targeting module and another Fab as the action module. Additionally, in certain configurations, the targeting module can be in the form of nAb/scFv/Fab, while the action module is in the form of IgGs (not shown).

Tissue-specific Wnt signal enhancing molecules may have different formats. Illustrative formats are depicted in FIG. 1A and FIG. 8. In particular embodiments, the tissue-specific Wnt signal enhancing molecules are fusion proteins comprising a first polypeptide sequence that binds to ZNRF3/RNF43 and a second polypeptide sequence that binds to one or more targeted tissue or cell type in a tissue- or cell-specific manner (see, e.g., FIG. 1A). In certain embodiments, the two polypeptide sequences may be fused directly or via a linker. In certain embodiments, the tissue-specific Wnt signal enhancing molecules comprise two or more polypeptides, such as dimers or multimers comprising two or more fusion proteins, each comprising the first domain and the second domain, wherein the two or more polypeptides are linked, e.g., through a linker moiety or via a bond between amino acid residues in each of the two or more polypeptides, e.g., an intermolecular disulfide bond between cysteine residues. In particular embodiments, a tissue-specific Wnt signal enhancing molecule is an antibody comprising antibody heavy and light chains (or antigen-binding fragments thereof) that constitute either the first domain or the second domain, wherein the other domain (i.e., the second domain or first domain) is linked to the antibody heavy chain or light chain, either as a fusion protein or via a linker moiety. In particular embodiments, the other domain is linked to the N-terminus of the heavy chain, the C-terminus of the heavy chain, the N-terminus of the light chain, or the C-terminus of the light chain. Such structures may be referred to herein as appended IgG scaffolds or formats. For example, a tissue-specific Wnt signal enhancing molecule can be an antibody that binds ZNRF3/RNF43, wherein a binding domain that binds a tissue- or cell-specific receptor is fused or appended to either the heavy chain or light chain of the antibody that binds ZNRF3/RNF43. In another example, a tissue-specific Wnt signal enhancing molecule can be an antibody that binds a tissue- or cell-specific receptor, wherein a binding domain that binds ZNRF3/RNF43 is fused or appended to either the heavy chain or light chain of the antibody that binds the tissue- or cell-specific receptor. In particular embodiments, a liver-specific Wnt signal enhancing molecule is an antibody or antigen-binding fragment thereof that binds ASGR1 or ASGR2, wherein a binding domain that binds ZNRF3/RNF43 is fused or appended to either the heavy chain or light chain of the antibody or antigen-binding fragment thereof (see, e.g., FIG. 8). In particular embodiments, the binding domain that bind ZNRF3/RNF43 comprises Fu1 and Fu2 domains, wherein the Fu1 and Fu2 domains optionally comprise one or more amino acid modifications, including any of those disclosed herein, e.g., F105R and/or F109A.

In certain embodiments, the tissue-specific Wnt signal enhancing molecules comprise a first domain ("action module") that binds ZNRF3/RNF43 and a second domain ("targeting module") that binds a tissue- or cell-specific receptor, e.g., with high affinity. In certain embodiments, each of these two domains has substantially reduced activity or is inactive in enhancing Wnt signals by itself. However, when the tissue-specific Wnt signal enhancing molecules engage with target tissues that express the tissue-specific receptor, E3 ligases ZNRF3/RNF43 are recruited to a ternary complex with the tissue-specific receptors, leading them to be sequestered, and/or cleared from the cell surface via receptor-mediated endocytosis. The net result is to enhance Wnt signals in a tissue-specific manner.

In certain embodiments, the action module is a binder to ZNRF3/RNF43 E3 ligases, and it can be designed based on R-spondins, e.g., R-spondins-1-4, including but not limited to human R-spondins-1-4. In certain embodiments, the action module is an R-spondin, e.g., a wild-type R-spondin-1-4, optionally a human R-spondin-1-4, or a variant or fragment thereof. In particular embodiments, it is a variant of any of R-spondins-1-4 having at least 80%, at least 85%, at least 90%, at least 95%, at least 98%, or at least 99% sequence identity to the corresponding wild-type R-spondin-1-4 sequence. In certain embodiments, the action module comprises or consists of a Furin domain 1 of an R-spondin, e.g., any of R-spondins 1-4, which bind ZNRF3/RNF43. Extended versions of Furin domain 1 (including, but not limited to, those with a mutated Furin domain 2 that no longer binds to LGR4-6 or has reduced binding to LGR4-6) or engineered antibodies or any other derivatives or any engineered polypeptides different from antibodies that are able to bind specifically to ZNRF3/RNF43 can also be used. In certain embodiments, the action module comprises one or more Furin domain 1 of an R-spondin. In certain embodiments, it does not comprise a Furin domain 2 of an R-spondin, or it comprises a modified or variant Furin domain 2 of an R-spondin, e.g., a Furin domain 2 with reduced activity as compared to the wild-type Furin domain 2. In certain embodiments, an action module comprises a Furin domain 1 but not a Furin domain 2 of R-spondin. In certain embodiments, an action module comprises two or more Furin domain 1 or multimers of a Furin domain 1. The action domain may comprise one or more wild-type Furin domain 1 of an R-spondin. In particular embodiments, the action module comprises a modified or variant Furin domain 1 of an R-spondin that has increased activity, e.g., binding to ZNRF3/RNF43, as compared to the wild-type Furin domain 1. Variants having increased binding to ZNRF3/RNF43 may be identified, e.g., by screening a phage or yeast display library comprising variants of an R-spondin Furin domain 1. Peptides or polypeptides unrelated to R-spondin Furin domain 1 but with increased binding to ZNRF3/RNF43 may also be identified through screening. Action modules may further comprise additional moieties or polypeptide sequences, e.g., additional amino acid residues to stabilize the structure of the action module or tissue-specific Wnt signal enhancing molecule in which it is present.

In certain embodiments, the action module comprises an antibody or antigen-binding fragment thereof that specifically binds ZNRF3 and/or RNF43. In particular embodiments, the action module is an antibody or an antigen-binding fragment thereof, comprising: a) CDRH1, CDRH2 and CDRH3 sequences set forth for any of the antibodies of Table 2A; and/or b) CDRL1, CDRL2 and CDRL3 sequences set forth for any of the antibodies of Table 2A, or a variant of said antibody, or antigen-binding fragment thereof, comprising one or more amino acid modifications, wherein said variant comprises less than 8 amino acid substitutions in said CDR sequences. In particular embodiments, the action module is an antibody or an antigen-binding fragment thereof, comprising a nanobody, VH or VL sequence set forth in Table 2B or SEQ ID NOs:78-150, or a fragment or variant thereof.

In further embodiments, the action module comprises another inhibitory moiety, such as a nucleic acid molecule, which reduces or prevents ZNRF3/RNF43 activity or expression, such as, e.g., an anti-sense oligonucleotide; a small interfering RNA (siRNA); a short hairpin RNA (shRNA); a microRNA (miRNA); or a ribozyme. As used herein, "antisense" refers to a nucleic acid sequence, regardless of length, that is complementary to a nucleic acid sequence. In certain embodiments, antisense RNA refers to single-stranded RNA molecules that can be introduced to an individual cell, tissue, or subject and results in decreased expression of a target gene through mechanisms that do not necessarily rely on endogenous gene silencing pathways. An antisense nucleic acid can contain a modified backbone, for example, phosphorothioate, phosphorodithioate, or others known in the art, or may contain non-natural internucleoside linkages. Antisense nucleic acid can comprise, e.g., locked nucleic acids (LNA). In particular embodiments, the nother inhibitor moiety inhibits an activity of one or both of ZNRF3/RNF43, or it inhibits the gene, mRNA or protein expression of one or both of ZNRF3/RNF43. In certain embodiments, the inhibitory moiety is a nucleic acid molecule that binds to a ZNRF3/RNF43 gene or mRNA, or a complement thereof.

"RNA interference" as used herein refers to the use of agents that decrease the expression of a target gene by degradation of a target mRNA through endogenous gene silencing pathways (e.g., Dicer and RNA-induced silencing complex (RISC)). RNA interference may be accomplished using various agents, including shRNA and siRNA. "Short hair-pin RNA" or "shRNA" refers to a double stranded, artificial RNA molecule with a hairpin turn that can be used to silence target gene expression via RNA interference (RNAi). Expression of shRNA in cells is typically accomplished by delivery of plasmids or through viral or bacterial vectors. shRNA is an advantageous mediator of RNAi in that it has a relatively low rate of degradation and turnover. Small interfering RNA (siRNA) is a class of double-stranded RNA molecules, usually 20-25 base pairs in length, similar to miRNA, and operating within the RNA interference (RNAi) pathway. It interferes with the expression of specific genes with complementary nucleotide sequences by degrading mRNA after transcription, preventing translation. In certain embodiments, an siRNA is 18, 19, 20, 21, 22, 23 or 24 nucleotides in length and has a 2-base overhang at its 3' end. siRNAs can be introduced to an individual cell and/or culture system and result in the degradation of target mRNA sequences. "Morpholino" as used herein refers to a modified nucleic acid oligomer wherein standard nucleic acid bases are bound to morpholine rings and are linked through phosphorodiamidate linkages. Similar to siRNA and shRNA, morpholinos bind to complementary mRNA sequences. However, morpholinos function through steric-inhibition of mRNA translation and alteration of mRNA splicing rather than targeting complementary mRNA sequences for degradation.

In certain embodiments, the targeting module specifically binds to a cell-specific surface molecule, e.g., a cell-specific surface receptor, and can be, e.g., natural ligands, antibodies, or synthetic chemicals. In particular embodiments, the cell-specific surface molecule is preferentially expressed on a target organ, tissue or cell type, e.g., an organ, tissue or cell type in which it is desirous to enhance Wnt signaling, e.g., to treat or prevent a disease or disorder. In particular embodiments, the cell-specific surface molecule has increased or enhanced expression on a target organ, tissue or cell type, e.g., an organ, tissue or cell type in which it is desirous to enhance Wnt signaling, e.g., to treat or prevent a disease or disorder, e.g., as compared to one or more other non-targeted organs, tissues or cell types. In certain embodiments, the cell-specific surface molecule is preferentially expressed on the surface of the target organ, tissue or cell type as compared to one or more other organ, tissue or cell types, respectively. For example, in particular embodiments, a cell surface receptor is considered to be a tissue-specific or cell-specific cell surface molecule if it is expressed at levels at least two-fold, at least five-fold, at least 10-fold, at least 20-fold, at least 30-fold, at least 40-fold, at least 50-fold, at least 100-fold, at least 500-fold, or at least 1000-fold higher in the target organ, tissue or cell than it is expressed in one or more, five or more, all other organs, tissues or cells, or an average of all other organs, tissue or cells, respectively. In certain embodiments, the tissue-specific or cell-specific cell surface molecule is a cell surface receptor, e.g., a polypeptide receptor comprising a region located within the cell surface membrane and an extracellular region to which the targeting module can bind. In various embodiments, the methods described herein may be practiced by specifically targeting cell surface molecules that are only expressed on the target tissue or a subset of tissues including the target tissue, or by specifically targeting cell surface molecules that have higher levels of expression on the target tissue as compared to all, most, or a substantial number of other tissues, e.g., higher expression on the target tissue than on at least two, at least five, at least ten, or at least twenty other tissues.

Tissue-specific and cell-specific cell surface receptors are known in the art. Examples of tissue- and cell-specific surface receptors include but are not limited to, ASGR1 (for liver specificity), ASGR2 (for liver specificity), TFR2 (for liver specificity), SLC10A1 (for liver specificity), PTH1R (for bone and kidney specificity), LYPD3 (for oral mucous specificity), DSG3 (for oral mucous specificity) etc. Additional receptors for liver delivery are described, e.g., by Yan et al., Tumor Biology, 2015; 36:55-67.

In certain embodiments, the targeting module comprises an antibody or antigen-binding fragment thereof that specifically binds ASGR1 and/or ASGR2. In particular embodiments, the second polypeptide is an antibody or an antigen-binding fragment thereof, comprising: a) CDRH1, CDRH2 and CDRH3 sequences set forth for any of the antibodies of Table 3A; and/or b) CDRL1, CDRL2 and CDRL3 sequences set forth for any of the antibodies of Table 3A, or a variant of said antibody, or antigen-binding fragment thereof, comprising one or more amino acid modifications, wherein said variant comprises less than 8 amino acid substitutions in said CDR sequences. In particular embodiments, the action module is an antibody or an antigen-binding fragment thereof, comprising a nanobody, VH or VL sequence set forth in Table 3B or SEQ ID NOs:47-77 or 151-154, or a fragment or variant thereof.

In particular embodiments, the tissue-specific Wnt signal enhancing molecule, or a pharmaceutically acceptable salt thereof, comprises a first domain that specifically binds one or more transmembrane E3 ubiquitin ligases selected from Zinc and Ring Finger 3 (ZNRF3) and Ring Finger Protein 43 (RNF43), and a second domain that specifically binds asialoglycoprotein receptor 1 (ASGR1) and/or asialoglycoprotein receptor 2 (ASGR2), wherein: (a) the first domain comprises an antibody or antigen-binding fragment thereof comprising: (i) CDRH1, CDRH2 and CDRH3 sequences set forth for any of the antibodies of Table 2A; and/or (ii) CDRL1, CDRL2 and CDRL3 sequences set forth for any of the antibodies of Table 2A, or a variant of said antibody, or antigen-binding fragment thereof, comprising one or more amino acid modifications, wherein said variant comprises less than 8 amino acid substitutions in said CDR sequences; and/or (b) the second domain comprises an antibody or antigen-binding fragment thereof comprising: (i) CDRH1, CDRH2 and CDRH3 sequences set forth for any of the antibodies of Table 3A; and/or (ii) CDRL1, CDRL2 and CDRL3 sequences set forth for any of the antibodies of Table 3A, or a variant of said antibody, or antigen-binding fragment thereof, comprising one or more amino acid modifications, wherein said variant comprises less than 8 amino acid substitutions in said CDR sequences. In particular embodiments, it comprises a polypeptide having at least 90% identify to any of SEQ ID NOs:47-77 or 151-154. In particular embodiments, it is a liver-specific Wnt signal enhancing molecule comprising an antibody or antigen-binding fragment thereof comprising: (i) CDRH1, CDRH2 and CDRH3 sequences set forth for any of the antibodies of Table 3A; and/or (ii) CDRL1, CDRL2 and CDRL3 sequences set forth for any of the antibodies of Table 3A, or a variant of said antibody, or antigen-binding fragment thereof, comprising one or more amino acid modifications, wherein said variant comprises less than 8 amino acid substitutions in said CDR sequences.

An action module or targeting module, e.g., an antibody or antigen-binding fragment thereof, that "specifically binds to" or is "specific for" a particular cell surface polypeptide or receptor is one that binds to that particular polypeptide or receptor without substantially binding to any other polypeptide or polypeptide epitope. In some embodiments, the action modules and targeting modules of the present disclosure specifically bind to ZNRF3/RNF43 or a tissue-specific cell surface molecule (e.g., receptor), respectively, with dissociation constants ($K_d$) equal to or lower than 1000 nM, equal to or lower than 100 nM, equal to or lower than 10 nM, equal to or lower than 1 nM, equal to or lower than 0.5 nM, equal to or lower than 0.1 nM, equal to or lower than 0.01 nM, equal to or lower than 0.005 nM, equal to or lower than 0.001 nM, or equal to or lower than 0.0005 nM, when measured at a temperature of about 4° C., 25° C., 37° C. or 42° C. Affinities of binders, e.g., antibodies, can be readily determined using conventional techniques, for example, those described by Scatchard et al. (Ann. N. Y. Acad. Sci. USA 51:660 (1949), ELISA assays, biolayer interferometry (BLI) assays, and surface plasmon resonance (SPR) assays). Binding properties of an antibody to antigens, cells or tissues thereof may generally be determined and assessed using immunodetection methods including, for example, immunofluorescence-based assays, such as immuno-histochemistry (IHC) and/or fluorescence-activated cell sorting (FACS).

In certain embodiments, the action module and/or the targeting module of the tissue-specific Wnt signal enhancing molecule are polypeptides, whereas in other embodiments, the action module and/or the targeting module of the tissue-specific Wnt signaling molecule are small organic molecules. In certain embodiments, the action module and the targeting module are both polypeptides, e.g., antibodies or antigen binding fragments thereof. In certain embodiments, the action module and the targeting module of a tissue-specific Wnt signal enhancing molecule are covalently bound to each other. In certain embodiments, the action module and the targeting module of a tissue-specific Wnt signal enhancing fusion molecule are non-covalently bound to each other. In certain embodiments, the action module and the targeting module of a tissue-specific Wnt signal enhancing molecule are present within the same fusion protein. In other embodiments, the action module is present within a first polypeptide further comprising a first binding domain, and the targeting module is present within a second polypeptide further comprising a second binding domain, wherein the first and second binding domain bind to each other. In some embodiments, the first and second binding domain are the same or variants thereof, such as, e.g., an Fc polypeptide. In some embodiments, the first and second binding domain are different from each other. In particular embodiments, the present invention includes the use of fragments or variants of any of the targeting modules or action modules described herein, including functional fragments or variants of the reference molecule.

In certain embodiments, a tissue-specific Wnt signal enhancing molecule (e.g., a fusion protein) has a formula selected from: $R_1$-L-$R_2$, and $R_2$-L-$R_1$, wherein $R_1$ is an action module that binds ZNRF3/RNF43, $R_2$ is a targeting module that binds a tissue-specific cell surface receptor, and L is a linker, and wherein L may be absent or present. Each of $R_1$ and $R_2$ may be any of the various action modules and targeting modules described herein, respectively. Each of $R_1$ and $R_2$ may be any moiety capable of binding to one or more of the E3 ligases (ZNRF3 or RNF43), or targeted tissue or cell, respectively. For example, each of $R_1$ and $R_2$ may be, but are not limited to, a moiety selected from: a polypeptide (e.g., an antibody or antigen-binding fragment thereof or a peptide or polypeptide different from an antibody), a small molecule, and a natural ligand or a variant, fragment or derivative thereof. In certain embodiments, the natural ligand is a polypeptide, a small molecule, an ion, an amino acid, a lipid, or a sugar molecule. The action module and the targeting module (i.e., $R_1$ and $R_2$) may be the same type of moiety as each other, or they may be different types of moieties. In particular embodiments, $R_2$ is an antibody of antigen-binding fragment thereof, and in certain embodiments, $R_2$ comprises an Fc protein or analog thereof.

In certain embodiments, a tissue-specific Wnt signal enhancing molecule comprises a single molecule (e.g., polypeptide), whereas in other embodiments, a Wnt signal enhancing fusion molecule comprises two or more molecules (e.g., polypeptides) bound to each other, e.g., non-covalently bound to each other. For example, in one embodiment, a tissue specific Wnt signal enhancing fusion comprises two molecules having formulas $R_3$-$L_1$ and $R_4$-$L_2$, respectively, wherein $R_3$ is an action module, $R_4$ is a targeting module, and wherein the $L_1$ and $L_2$ groups bind to each other, e.g., to form a dimer. In various embodiments, the $L_1$ and $L_2$ groups are the same as each other or different from one another. One example of an $L_1$ or $L_2$ group is an Fc sequence, e.g., murine Fc2b or human Fc1, each of which is known in the art. Each of $R_3$ and $R_4$ may be any of the various action modules and targeting modules described herein, respectively. Each of $R_3$ and $R_4$ may be any moiety capable of binding to one or more of the E3 ligases (ZNRF3 and/or RNF43), or targeted tissue or cell, respectively. In particular embodiments, a tissue-specific Wnt signal enhancing molecule comprises an antibody or binding fragments thereof that binds one or more of the E3 ligases (ZNRF3 and/or RNF43), wherein the antibody heavy chain and/or the antibody light chain comprises an appended binding domain that binds a targeted tissue or cell. In particular embodiments, a tissue-specific Wnt signal enhancing molecule comprises an antibody or binding fragments thereof that binds a targeted tissue or cell, wherein the antibody heavy chain and/or the antibody light chain comprises an appended binding domain that binds one or more of the E3 ligases (ZNRF3 and/or RNF43). The appended binding domain may be directly fused to the N-terminus or C-terminus of the antibody, e.g., as a heavy chain or light chain fusion protein, or it may be appended to the heavy chain or light chain via a linker moiety, e.g., to the N-terminus, C-terminus, or an internal amino acid of the heavy chain or light chain. In certain embodiments, the antibody is an IgG.

In certain embodiments, the tissue-specific Wnt signal enhancing molecules (e.g., fusion proteins) increase Wnt signaling in a liver tissue or liver cell contacted with the fusion protein. In particular embodiments, Wnt signaling in the liver tissue or cell type is increased by at least 50%, at least two-fold, at least three-fold, at least four-fold, at least five-fold, or at least ten-fold.

Tissue-specific Wnt signal enhancing molecules may be produced by standard methods of organic synthesis and molecular biology known and available in the art. For example, a tissue-specific Wnt signal enhancing fusion protein may be generated by fusing a targeting module (e.g., an antibody or antigen-binding fragment thereof that bind ASGR1 or ASGR2) to an action module (e.g., human R-spondin 2 Furin domain 1 alone, corresponding to amino acid residues N37-R95, or human R-spondin 2 Furin domain 1 followed by a Furin domain 2, in which the Furin domain 2 interaction with the LGR proteins is abolished or compromised by point mutations, e.g., F105A and F109A, singly or in combination). In certain embodiments, the targeting module and action module are fused by a linker, e.g., a glycine-serine linker, with either domain located at the N-terminus of the tissue-specific Wnt signal enhancing molecule. In certain embodiments, the targeting module and action module are fused by a protein linker (e.g., albumin). Additional ways of "fusing" the targeting module with the action module include, but are not limited to, "knob-in-hole" or leucine zipper mediated dimerization, for example. DNA sequences encoding the targeting module, the action module (and, optionally, a linker) may be genetically engineered to encode the desired fusion protein.

For tissue-specific Wnt signal enhancing fusion molecules, including antibody heavy and light chains, the DNA sequences encoding different parts of the fusion proteins may be inserted into bacterial or eukaryotic expression vectors using standard molecular cloning techniques, and expressed in appropriate host cells. The expressed fusion proteins may be purified to homogeneity using standard techniques in protein science such as affinity, ion-exchange, and size-exclusion chromatography. The present disclosure also includes functional fragments and variants of any of the polypeptide action modules, targeting modules, and fusion proteins described herein, including variants having at least 50%, at least 60%, at least 70%, at least 80%, at least 85%, at least 90%, at least 95%, at least 98% or at least 99% polypeptide sequence identity to an action module, targeting module, or fusion protein described herein. Such variants may comprise one or more amino acid modifications as compared to any of the sequences disclosed herein, e.g., one or more amino acid deletion, insertion or substitution. In particular embodiments, functional fragments and variants of tissue-specific Wnt signal enhancing fusion proteins have at least 5%, at least 10%, at least 20%, at least 30%, at least 40%, at least 50%, at least 60%, at least 70%, at least 80% at least 90% at least 100% or more Wnt signal enhancing activity as compared to the tissue-specific Wnt signal enhancing fusion protein from which they were derived. In certain embodiments, functional fragments and variants of polypeptide action modules have at least 5%, at least 10%, at least 20%, at least 30%, at least 40%, at least 50%, at least 60%, at least 70%, at least 80% at least 90% at least 100% or more Wnt signal enhancing activity as compared to the action module from which they were derived (when measured in the context of the entire tissue-specific Wnt signal enhancing molecule). In certain embodiments, functional fragments and variants of targeting modules have at least 5%, at least 10%, at least 20%, at least 30%, at least 40%, at least 50%, at least 60%, at least 70%, at least 80% at least 90% at least 100% or more binding activity as compared to the targeting module from which they were derived.

The present disclosure also includes polynucleotides or nucleic acid sequences that encode one or more tissue-specific Wnt signal enhancing molecules or components thereof, e.g., fusion proteins or variants thereof, described herein, and vectors comprising these polynucleotides, including expression vectors, and cells comprising these vectors. In certain embodiments, the polynucleotides or nucleic acid sequences are DNA or RNA. In particular embodiments, the RNA is messenger RNA (mRNA). In certain embodiments, the RNA is a modified mRNA comprising one or more modified nucleosides. Modified mRNAs comprising one or more modified nucleoside have been described as having advantages over unmodified mRNAs, including increase stability, higher expression levels and reduced immunogenicity. Non-limiting examples of modified mRNAs that may be used according to the present invention are described, e.g., in PCT Patent Application Publication Nos. WO2011/130624, WO2012/138453, WO2013052523, WO2013151666, WO2013/071047, WO2013/078199, WO2012045075, WO2014081507, WO2014093924, WO2014164253, U.S. Pat. No. 8,278,036 (describing modified mRNAs comprising pseudouridine), U.S. Pat. No. 8,691,966 (describing modified mRNAs comprising pseudouridine and/or N1-methylpseudouridine), U.S. Pat. No. 8,835,108 (describing modified mRNAs comprising 5-methylcytidine, U.S. Pat. No. 8,748,089 (describing modified mRNAs comprising pseudouridine or 1-methylpseudouridine). In particular embodiments, the modified mRNA sequence encoding the tissue-specific Wnt signal enhancing polypeptide comprises at least one modification as compared to an unmodified A, G, U or C ribonucleoside. In particular embodiments, the at least one modified nucleosides include N1-methylpseudouridine and/or 5-methylcytidine. In particular embodiments, the modified mRNA comprises a 5' terminal cap sequence followed by a sequence encoding the tissue-specific Wnt signal enhancing polypeptide, following by a 3' tailing sequence, such as a polyA or a polyA-G sequence.

In particular embodiments, the polynucleotide is a vector, e.g., an expression vector, and the expression vector comprises a polynucleotide sequence encoding a tissue-specific Wnt signal enhancing fusion molecule (e.g., a fusion protein or one or both chains of an appended antibody) described herein operably linked to a promoter sequence, e.g., a promoter sequence that drives expression of the polynucleotide in a cell. In certain embodiments, the vector is a viral vector, e.g., a virus comprising a polynucleotide comprising an expression cassette comprising a promoter operably linked to a DNA or RNA sequence encoding the tissue-specific Wnt signal enhancing polypeptide. In particular embodiments, the expression cassette comprises 5' and/or 3' cellular or viral UTRs or the derivatives thereof.

The present disclosure also includes functional fragments and variants of the polynucleotides described herein, including variants having at least 50%, at least 60%, at least 70%, at least 80%, at least 85%, at least 90%, at least 95%, at least 98% or at least 99% polynucleotide sequence identity to a polynucleotide described herein. Such variants may comprise one or more nucleotide or nucleoside modifications as compared to any of the sequences disclosed herein, e.g., one or more nucleotide deletion, insertion or substitution. In particular embodiments, the polynucleotides described herein are codon-optimized, e.g., to enhance expression of the encoded polypeptide in a host cell. In particular embodiments, polynucleotide variants comprise one or more modified nucleotide or nucleoside.

The present disclosure also includes cells comprising a polynucleotide or vector that encodes a tissue-specific Wnt signal enhancing molecule, e.g., fusion protein, described herein. In certain embodiments, the cell is a host cell, such as, e.g., an HEK293 cell that may be used to produce tissue-specific Wnt signal enhancing fusion proteins. In preparing the subject compositions, any host cells may be employed, including but not limited to, for example, mammalian cells (e.g. 293 cells), insect cells (e.g., SF9 cells), microorganisms and yeast. In certain embodiments, the cells are heterologous or autologous to a subject treated with a tissue-specific Wnt signal enhancing polypeptide described herein. In particular embodiments, the cells were obtained from the subject and transduced with a viral vector described herein. In particular embodiments, the transduced cells are delivered to the subject for treatment.

The present disclosure also includes pharmaceutical compositions comprising one or more tissue-specific Wnt signal enhancing molecules (e.g., fusion proteins), or one or more polynucleotides or vectors comprising sequences encoding a tissue-specific Wnt signal enhancing molecule.

Wnt signaling may be measured using techniques and assays known and available in the art. In certain embodiments, an increase in Wnt signaling is determined using a cell line corresponding to a target tissue or cell type. In particular embodiments, the cell line contains a reporter plasmid with a marker gene (e.g., a luciferase gene) under the control of a Wnt signal-responsive promoter. Enhanced reporter activity of the cells in response to Wnt3a, Wnt3a conditioned media, or recombinant sources of Wnt3a, by the addition of either Furin domain 1 alone (or together with Furin domain 2, with the F105A and/or F109A point mutations) as a negative control or functional R-spondin (full length or Furin domains 1 and 2) as a positive control may be determined. Reporter activity in response to the tissue-specific Wnt signal enhancing molecules may also be determined by contacting the reporter cell line with the tissue specific Wnt signal enhancing molecule. The negative control may be substantially, significantly, or completely negative for reporter activity, and the tissue-specific Wnt signal enhancing molecule and positive control should show an increase in Wnt signaling response as an increase in reporter activity. Additional controls may include an anti-ASGR1 antibody alone (negative), a fusion protein in which an anti-GFP antibody is used in place of an anti-ASGR1 antibody (negative), and intact Furin domain 1-Furin domain 2 protein (positive). Tissue specificity of the tissue-specific Wnt signal enhancing molecule may be determined by similarly measuring the reporter activity in response to treatment with the tissue-specific Wnt signal enhancing molecule in cell types or tissues other than those targeted. In certain embodiments, reporter activity is higher in the targeted tissue bound by the tissue-specific Wnt signal enhancing molecule as compared to non-targeted tissues, e.g., at least 50%, at least two-fold, at least three-fold, at least four-fold, at least five-fold, or at least ten-fold higher.

In particular embodiments, a tissue-specific Wnt signal enhancing polypeptide comprises any combination of action module and targeting module, including any combination of any of the action modules and targeting modules described herein. In particular embodiments, they are joined by a linker, e.g., albumin (e.g., human serum albumin), a peptidyl linker, or a non-peptidyl linker, where the targeting and action modules are on the N- and C-termini of the linker, e.g., Fc or albumin, peptidyl linker, or non-peptidyl linker.

The tissue-specific Wnt signal enhancing molecules can also be joined to a moiety such as a polyethylene glycol (PEG), Fc, albumin, etc. as known in the art to enhance stability in vivo.

Illustrative, non-limiting examples of tissue-specific Wnt signal enhancing molecules include the following:
a) a bone tissue specific Wnt signal enhancing polypeptide comprising an action module comprising a variant or fragment of an R-spondin (e.g., human R-spondin 2) having reduced ability to enhance Wnt signaling and a targeting module that specifically binds PTH1R, wherein the tissue specific Wnt signal enhancing polypeptide increases Wnt signaling in bone tissue and may be used to treat a disease or condition of bone tissue;
b) a liver tissue specific Wnt signal enhancing polypeptide comprising an action module comprising a variant or fragment of an R-spondin (e.g., human R-spondin 2) having reduced ability to enhance Wnt signaling and a targeting module that specifically binds ASGR1, ASGR2, TFR2, or SLC10A1, wherein the tissue specific Wnt signal enhancing polypeptide increases Wnt signaling in liver tissue and may be used to treat a disease or condition of liver tissue; or
c) an oral mucosal tissue specific Wnt signal enhancing polypeptide comprising an action module comprising a variant or fragment of an R-spondin (e.g., human R-spondin 2) having reduced ability to enhance Wnt signaling and a targeting module that specifically binds LYPDS3 or DSG3, wherein the tissue specific Wnt signal enhancing polypeptide increases Wnt signaling in oral mucosal tissue and may be used to treat a disease or condition of oral mucosal tissue Illustrative, non-limiting examples of tissue-specific Wnt signal enhancing molecules include those described in the accompanying Examples and sequences, including but not limited to those described in Table 1. In particular embodiments, a tissue-specific Wnt signal enhancing molecule comprises two or more polypeptide sequences disclosed herein, e.g., in the appended IgG or antibody format. Polypeptides disclosed herein include but are not limited to polypeptides comprising or consisting of a sequence having at least 80%, at least 85%, at least 90%, at least 95%, at least 98%, or at least 99% identity to any of the sequences set forth in Table 1 and fragments and variants thereof. In particular embodiments, polypeptides comprises the action module or targeting module present within ant of the sequences set forth in Table 1 (e.g., they may lack tags (e.g., His tag or Flag tag) or other additional sequences), and fragments and variants thereof. In certain embodiments, the polypeptides have activity as an action module and/or a targeting module.

Illustrative, non-limiting examples of polynucleotides disclosed herein include any that encode for any of the polypeptides, variants and fragments described herein, including those described above. In certain embodiments, the polynucleotides encode polypeptides that have activity as a functional domain and/or a targeting module.

TABLE 1

Description of Sequence Identifiers

| Figure | SEQ ID NO: | Brief Description |
|---|---|---|
| 1 | 1 | Full length human RSPO1 (PP) |
| 1 | 2 | Full length human RSPO2 (PP) |
| 1 | 3 | Full length human RSPO3 (PP) |
| 1 | 4 | Full length human RSPO4 (PP) |
| 1, 2, 3 | 5 & 6 | anti-GFP, RSPO2 wild type (PN & PP) |
| 1, 2, 3 | 7 & 8 | anti-GFP, RSPO2 (F105R/F109A) (PN & PP) |
| 1, 2, 3 | 9 & 10 | anti-GFP, RSPO2 (R65A/R69A/Q70A/F105A/F109A) (PN & PP) |
| 1, 2, 3 | 11 & 12 | anti-ASGR1, RSPO2 wild type (PN & PP) |
| 1, 2, 3 | 13 & 14 | anti-ASGR1, RSPO2 (F105R/F109A) (PN & PP) |
| 1, 2, 3 | 15 & 16 | anti-ASGR1, RSPO2 (R65A/R69A/Q70A/F105A/F109A) (PN & PP) |
| 4 | 17 & 18 | anti-TFR1, RSPO2 wild type (PN & PP) |
| 4 | 19 & 20 | anti-TFR1, RSPO2 (F105R/F109A) (PN & PP) |
| 4 | 21 & 22 | anti-TFR1, RSPO2 (R65A/R69A/Q70A/F105A/F109A) (PN & PP) |
| 5, 9-15 | 23 & 24 | Fc-RSPO2 (PN & PP) <br> αGFP-RSPO2-RA-IgG |
| 5, 6, 9, 13-15 | 25 & 26 | anti-GFP light chain (PN & PP) |
| 5, 6, 9, 13 & 15 | 27 & 28 | RSPO2 (F105R/F109A), anti-GFP Heavy chain IgG2 (PN & PP) <br> αASGR1-RSPO2-RA-IgG |
| 5, 6, 9, 13 & 15 | 29 & 30 | anti-ASGR1 light chain (PN & PP) |
| 5, 6, 9, 13 & 15 | 31 & 32 | RSPO2 (F105R/F109A), anti-ASGR1 Heavy chain IgG2 (PN & PP) <br> αGFP-IgG |
| 5 & 6 | 25 & 26 | anti-GFP light chain (PN & PP) |
| 5 & 6 | 33 & 34 | anti-GFP Heavy chain IgG1 (PN & PP) <br> ASGR ECDs |
| 7 & 9 | 35 & 36 | hASGR1 ECD |
| 9 | 163 & 164 | mASGR1 ECD |
| 7 | 37 & 38 | hASGR2 ECD |
|  | 39 & 40 | cynoASGR1 ECD |
|  | 41 & 42 | cynoASGR2 ECD |

TABLE 1-continued

Description of Sequence Identifiers

| Figure | SEQ ID NO: | Brief Description |
|---|---|---|
| | | E3 ligase ECDs |
| 1 & 4 | 43 & 44 | hRNF43 ECD |
| 1 & 4 | 45 & 46 | hZNRF3 ECD |
| | | anti-β-Gal |
| 9, 10, 13 & 15 | 155 & 156 | anti-β-Gal light chain (PN & PP) |
| 9 | 157 & 158 | anti-β-Gal Heavy chain IgG1-LALAPG (PN & PP) |
| 10, 13 & 15 | 159 & 160 | anti-β-Gal Heavy chain IgG2 (PN & PP) |
| | | anti-ASGR1 Fab |
| 9 | 29 & 30 | anti-ASGR1 light chain (PN & PP) |
| 9 | 161 & 162 | anti-ASGR1 VH-CH1 (PN & PP) |
| | | α-β-Gal-RSPO2-RA-IgG (C-HC appended) |
| 14 | 155 & 156 | anti-β-Gal light chain (PN & PP) |
| 14 | 186 & 187 | anti-β-Gal Heavy chain IgG2, RSPO2 (F105R/F109A) (PN & PP) |
| | | α-GFP-RSPO2-RA-IgG (C-HC appended) |
| 14 | 25 & 26 | anti-GFP light chain (PN & PP) |
| 14 | 188 & 189 | anti-GFP Heavy chain IgG2, RSPO2 (F105R/F109A) (PN & PP) |
| | | LP1-1F8-RSPO2-RA-IgG (C-HC appended) |
| 14 | 190 & 191 | LP1-1F8 light chain (PN & PP) |
| 14 | 192 & 193 | LP1-1F8 Heavy chain IgG2, RSPO2 (F105R/F109A) (PN & PP) |
| | | LP1-1N15-RSPO2-RA-IgG (C-HC appended) |
| 14 | 194 & 195 | LP1-1N15 light chain (PN & PP) |
| 14 | 196 & 197 | LP1-1N15 Heavy chain IgG2, RSPO2 (F105R/F109A) (PN & PP) |
| | | LP1-1P13-RSPO2-RA-IgG (C-HC appended) |
| 14 | 198 & 199 | LP1-1P13 light chain (PN & PP) |
| 14 | 200 & 201 | LP1-1P13 Heavy chain IgG2, RSPO2 (F105R/F109A) (PN & PP) |
| | | LP1-1P5-RSPO2-RA-IgG (C-HC appended) |
| 14 | 202 & 203 | LP1-1P5 light chain (PN & PP) |
| 14 | 204 & 205 | LP1-1P5 Heavy chain IgG2, RSPO2 (F105R/F109A) (PN & PP) |
| | | LP1-2E12-RSPO2-RA-IgG (C-HC appended) |
| 14 | 206 & 207 | LP1-2E12 light chain (PN & PP) |
| 14 | 208 & 209 | LP1-2E12 Heavy chain IgG2, RSPO2 (F105R/F109A) (PN & PP) |
| | | LP1-2I13-RSPO2-RA-IgG (C-HC appended) |
| 14 | 210 & 211 | LP1-2I13 light chain (PN & PP) |
| 14 | 212 & 213 | LP1-2I13 Heavy chain IgG2, RSPO2 (F105R/F109A) (PN & PP) |
| | | LP1-2I22-RSPO2-RA-IgG (C-HC appended) |
| 14 | 214 & 215 | LP1-2I22 light chain (PN & PP) |
| 14 | 216 & 217 | LP1-2I22 Heavy chain IgG2, RSPO2 (F105R/F109A) (PN & PP) |
| | | LP1-3A24-RSPO2-RA-IgG (C-HC appended) |
| 14 | 218 & 219 | LP1-3A24 light chain (PN & PP) |
| 14 | 220 & 221 | LP1-3A24 Heavy chain IgG2, RSPO2 (F105R/F109A) (PN & PP) |
| | | LP1-3E20-RSPO2-RA-IgG (C-HC appended) |
| 14 | 222 & 223 | LP1-3E20 light chain (PN & PP) |
| 14 | 224 & 225 | LP1-3E20 Heavy chain IgG2, RSPO2 (F105R/F109A) (PN & PP) |
| | | LP1-6H3-RSPO2-RA-IgG (C-HC appended) |
| 14 | 226 & 227 | LP1-6H3 light chain (PN & PP) |
| 14 | 228 & 229 | LP1-6H3 Heavy chain IgG2, RSPO2 (F105R/F109A) (PN & PP) |

TABLE 1-continued

Description of Sequence Identifiers

| Figure | SEQ ID NO: | Brief Description |
|---|---|---|
| | | LP1-7B13-RSPO2-RA-IgG (C-HC appended) |
| 14 | 230 & 231 | LP1-7B13 light chain (PN & PP) |
| 14 | 232 & 233 | LP1-7B13 Heavy chain IgG2, RSPO2 (F105R/F109A) (PN & PP) |
| | | LP1-7I20-RSPO2-RA-IgG (C-HC appended) |
| 14 | 234 & 235 | LP1-7I20 light chain (PN & PP) |
| 14 | 236 & 237 | LP1-7I20 Heavy chain IgG2, RSPO2 (F105R/F109A) (PN & PP) |
| | | LP1-8M24-RSPO2-RA-IgG (C-HC appended) |
| 14 | 238 & 239 | LP1-8M24 light chain (PN & PP) |
| 14 | 240 & 241 | LP1-8M24 Heavy chain IgG2, RSPO2 (F105R/F109A) (PN & PP) |
| | | LP1-9C3-RSPO2-RA-IgG (C-HC appended) |
| 14 | 242 & 243 | LP1-9C3 light chain (PN & PP) |
| 14 | 244 & 245 | LP1-9C3 Heavy chain IgG2, RSPO2 (F105R/F109A) (PN & PP) |
| | | LP1-9M16-RSPO2-RA-IgG (C-HC appended) |
| 14 | 246 & 247 | LP1-9M16 light chain (PN & PP) |
| 14 | 248 & 249 | LP1-9M16 Heavy chain IgG2, RSPO2 (F105R/F109A) (PN & PP) |
| | | LP1-10C22-RSPO2-RA-IgG (C-HC appended) |
| 14 | 250 & 251 | LP1-10C22 light chain (PN & PP) |
| 14 | 252 & 253 | LP1-10C22 Heavy chain IgG2, RSPO2 (F105R/F109A) (PN & PP) |
| | | LP1-1N15-RSPO2-RA, IgG1 N297G (N-HC appended) |
| 14-15 | 194 & 195 | LP1-1N15 light chain (PN & PP) |
| 14-15 | 254 & 255 | RSPO2 (F105R/F109A), LP1-1N15 Heavy chain IgG1 N297G (PN & PP) |
| | | LP1-1P13-RSPO2-RA-IgG1 N297G (N-HC appended) |
| 14-15 | 198 & 199 | LP1-1P13 light chain (PN & PP) |
| 14-15 | 256 & 257 | RSPO2 (F105R/F109A), LP1-1P13 Heavy chain IgG1 N297G (PN & PP) |
| | | LP1-2I13-RSPO2-RA-IgG1 N297G (N-HC appended) |
| 14-15 | 210 & 211 | LP1-2I13 light chain (PN & PP) |
| 14-15 | 258 & 259 | RSPO2 (F105R/F109A), LP1-2I13 Heavy chain IgG1 N297G (PN & PP) |
| | | LP1-2I22-RSPO2-RA-IgG1 N297G (N-HC appended) |
| 14-15 | 214 & 215 | LP1-2I22 light chain (PN & PP) |
| 14-15 | 260 & 261 | RSPO2 (F105R/F109A), LP1-2I22 Heavy chain IgG1 N297G (PN & PP) |
| | | LP1-3A24-RSPO2-RA-IgG1 N297G (N-HC appended) |
| 14-15 | 230 & 231 | LP1-7B13 light chain (PN & PP) |
| 14-15 | 266 & 267 | RSPO2 (F105R/F109A), LP1-7B13 Heavy chain IgG1 N297G (PN & PP) |
| | | LP1-8M24-RSPO2-RA-IgG1 N297G (N-HC appended) |
| 14-15 | 238 & 239 | LP1-8M24 light chain (PN & PP) |
| 14-15 | 268 & 269 | RSPO2 (F105R/F109A), LP1-8M24 Heavy chain IgG1 N297G (PN & PP) |
| | | LP1-9M16-RSPO2-RA-IgG1 N297G (N-HC appended) |
| 14-15 | 246 & 247 | LP1-9M16 light chain (PN & PP) |
| 14-15 | 270 & 271 | RSPO2 (F105R/F109A), LP1-9M16 Heavy chain IgG1 N297G (PN & PP) |
| 15 | 29 & 30 | Anti-ASGR1 light chain (PN & PP) |
| 15 | 272 & 273 | Anti-ASGR1 heavy chain IgG2 (PN & PP) |

Action Modules

R-spondins are capable of amplifying Wnt signals. The minimal functional unit of R-spondin is composed of two Furin domains, Furin domain 1 that binds to ZNRF3/RNF43 E3 ligases, and Furin domain 2 that binds to LGR4-6, bringing together a ternary complex of R-spondin, LGR, and the E3 ligases. This results in internalization of the whole complex and removal of ZNRF3/RNF43 away from their targets of destruction. Furin domain 1 alone is not functional, but it is capable of binding to both ZNRF3 and RNF43.

The action module of the tissue-specific Wnt signal enhancing molecules described herein can be, but is not limited to, any functional moiety that can bind to the ZNRF3/RNF43 ligases, e.g., polypeptides or organic chemicals. In particular embodiments, the action module, for example a polypeptide comprising the Furin domain 1 of an R-spondin, either alone or together with the targeting module, is substantially inactive in non-target tissues, so as to minimize potential off-target effects. The action module is fused to or bound to a targeting module in the context of a tissue-specific Wnt signal enhancing molecule, and when the tissue-specific Wnt signal enhancing molecule engages with target tissue that express the tissue-specific receptor, E3 ligases ZNRF3/RNF43 are recruited to a ternary complex with the tissue-specific specific receptors, leading them to be relocated on the cell surface, sequestered, and/or cleared from the cell surface.

In certain embodiments, the action module comprises a fragment or variant of an R-spondin polypeptide (e.g., any of R-spondins 1-4), or a functional fragment or variant thereof. In particular embodiments, the action module comprises a fragment of a wild-type R-spondin, and in other embodiments, the action module comprises a fragment of an R-spondin comprising one or more amino acid modifications. The R-spondin may be any R-spondin known in the art or a homolog thereof, including R-spondins from any animal species, including but not limited to mammalian species, such as human R-spondins. R-spondins have been identified and described, and their polypeptide and encoding polynucleotide sequences are known and available in the art. In particular embodiments, the R-spondin polypeptide is a human R-spondin or a homolog found in other vertebrates or non-vertebrates, e.g., a mouse R-spondin. Amino acid sequences of human R-spondin 1, human R-spondin 2, human R-spondin 3, and human R-spondin 4, and the Furin domains 1 thereof, are provided in FIG. 1 and SEQ ID NOs:1-4, respectively. Their homologues and variants are available from general database search, such as https://www.dot.ncbi.dot.nlm.dot.nih.dot.gov/protein/. The present invention includes (but is not limited to) action modules comprising or consisting of fragments and variants of any of these or other R-spondins. In various embodiments, variants of any of the R-spondin polypeptides and fragments thereof comprise one or more amino acid modifications, e.g., deletions, additions, or substitutions as compared to the wild-type R-spondin polypeptide. The modification(s) may be present in any region of the variant of R-spondin or a fragment thereof, including but not limited to a Furin domain 1 and/or a Furin domain 2. It is understood that amino acid modifications outside of the Furin domain 1 or Furin domain 2 may alter the resulting variant such that the resulting variant has reduced LGR4-6 binding activity as compared to the wild-type R-spondin or fragment thereof.

In certain embodiments, the action module comprises or consists of an R-spondin sequence, e.g., a full length or wild-type R-spondin-1, -2, -3 or -4, optionally a human R-spondin-1, -2, -3, or -4, or a variant or fragment thereof. In particular embodiments, it is a variant of any of R-spondins-1-4 having at least 80%, at least 85%, at least 90%, at least 95%, at least 98%, or at least 99% sequence identity to the corresponding wild-type R-spondin-1-4 sequence. In certain embodiments, the action module comprises or consists of a full length R-spondin (e.g., any of R-spondins-1-4) comprising one or more amino acid modifications, including but not limited to any of those disclosed herein. In certain embodiments, the action module comprises or consists of a fragment of a wild-type or modified R-spondin (e.g., any of R-spondins-1-4). In particular embodiments, the fragment is able to bind to ZNRF3 and/or RNF43. In certain embodiments, the action module comprises the Furin domain 1 of an R-spondin spondin protein, or fragments or variants of R-spondin proteins. In certain embodiments, the action module comprises or consists of one or more (e.g., one, two or three or more Furin domain 1 of an R-spondin protein (e.g., R-spondin-1-4), or a variant thereof having at least 85%, at least 90%, at least 95%, at least 98% or at least 99% sequence identify to an R-spondin Furin domain 1. In certain embodiments, the action module comprises an R-spondin Furin 1 domain or variant or fragment thereof and an R-spondin Furin 2 domain or variant or fragment thereof. In certain embodiments, the action module comprises an antibody, or antigen binding fragment thereof, that bind ZNRF3/RNF43. In particular embodiments, the action module specifically binds to either ZNRF3 or RNF43.

In certain embodiments, the action module comprises one or more Furin domain 1 of an R-spondin, e.g., human R-spondin 1 or human R-spondin 2, or a variant thereof. In certain embodiments, the action module comprises one or more Furin domain 1 of an R-spondin, but it does not comprise a Furin domain 2 of an R-spondin. In certain embodiments, the action module comprises one or more Furin domain 1 of an R-spondin, and it comprises a modified or variant Furin domain 2 of an R-spondin, e.g., a Furin domain 2 with reduced activity as compared to the wild-type Furin domain 2. In certain embodiments, the action module comprises an R-spondin protein having a modified or variant Furin domain 2 of an R-spondin, e.g., a Furin domain 2 with reduced activity as compared to the wild-type Furin domain 2. In certain embodiments, an action module comprises two or more Furin domains 1, or variants thereof, or multimers of a Furin domain 1 or variant thereof. In certain embodiments, the action module comprises a variant R-spondin Furin 1 domain comprising one or more point mutations, e.g., at amino acid residues corresponding to K58, H76, S77, R86, and/or N91 of human R-spondin 2. In certain embodiments, the action module comprises a variant R-spondin Furin 2 domain comprising one or more point mutations, e.g., at amino acid residues corresponding to F105, F109 and/or K121 of human R-spondin 2. In particular embodiments, the action module comprises a modified or variant Furin domain 1 of an R-spondin that has increased activity, e.g., binding to ZNRF3/RNF43, as compared to the wild-type Furin domain 1. Action modules may further comprise additional moieties or polypeptide sequences, e.g., additional amino acid residues to stabilize the structure of the action module or tissue-specific Wnt signal enhancing molecule in which it is present. In certain embodiments, an action module comprises a peptide or polypeptide without obvious/strong sequence homology to R-spondins but has binding affinity to ZNRF3/RNF43 comparable to or higher than the binding affinity of R-spondins to ZNRF3/RNF43.

In certain embodiments, the action module comprises a Furin domain 1 of an R-spondin polypeptide (e.g., a human R-spondin), or a functional fragment or variant thereof, and a modified or variant Furin domain 2 of an R-spondin polypeptide (e.g., a human R-spondin), wherein the modified Furin domain 2 has reduced binding affinity to LGR4-6 as compared to the corresponding wild-type Furin domain 2 (see FIGS. 1 and 4). In certain embodiments, the Furin domain 2 comprises one or more point mutations, e.g., at amino acid residues corresponding to F105 and/or F109 of human R-spondin 2. The skilled artisan can readily determine the corresponding amino acid residues in other R-spondin polypeptides by comparing their amino acid sequences to human R-spondin 2. In certain embodiments, the action module comprises a Furin domain 1 or variant thereof and a Furin domain 2 or variant thereof, wherein the Furin domain 1 and/or Furin domain 2 comprises one or more point mutations. The one or more point mutations within the action module (as compared to the corresponding wild-type R-spondin sequence) may occur at any amino acid residues within the Furin domain 1 and/or Furin domain 2, including but not limited to, e.g., at amino acid residues K58, H76, S77, R86, N91, F105, F109, or K121 and other residues that can be modified to reduce the binding affinity to LGR4-6. Regions of the Furin domain 1 and Furin domain 2 of human R-spondin 1 that are important for its functional activity have been identified, including conserved hydrophilic residues S48, N51, R66, R70 and Q71, and less conserved, hydrophobic residues, L46, L54, I62 and L64, which are important for binding to the E3 ligases. In addition, in the human R-spondin 1 Furin domain 1, amino acid residues K59, S78, D85, R87, N88 and N92 form a hydrophilic interaction surface with LGR5, and the FSHNF amino acid sequence has been identified as a loop important for the hydrophobic surface. In particular embodiments, action modules comprising R-spondin Furin domain 1 and/or Furin domain 2 may comprise one or more mutations within any of these regions, surfaces or amino acid residues. In particular embodiments, action modules comprising R-spondin Furin domain 1 and/or Furin domain 2 may comprise one or more mutations or other alternations beyond these regions, surfaces or amino acid residues, which indirectly compromise LGR4-6 binding by affecting the structure and/or stability of the binding surface. In certain embodiments, action modules comprising R-spondin Furin domain 1 and/or Furin domain 2 may comprise one or more mutations at any amino acid residues, including but not limited to any of those depicted in the accompanying Examples. In particular embodiments, the action module comprises a modified Furin domain 2 comprising amino acid substitutions at amino acid residues F105 and/or F109. In particular embodiments, the action module comprises a Furin 1 domain and a modified Furin domain 2 comprising amino acid substitutions at amino acid residues F105 and/or F109. In particular embodiments, the action module comprises a modified Furin 1 domain and a modified Furin 2 domain, where in certain embodiments, the modified Furin 1 domain comprises one or more amino acid modifications at amino acids R65, R69 and/or Q70, and the modified Furin domain comprises one or more amino acid modification at amino acids F105 and/or F109. In particular embodiments, the modified Furin domain 2 has binding affinity to LGR4-6 less than 80%, less than 50%, less than 20%, or less than 10% the binding of the corresponding wild-type Furin domain 2, e.g., in the context of the full length R-spondin protein.

In certain embodiments, the action module comprises a Furin domain 1 of an R-spondin polypeptide (e.g., a human R-spondin), or a functional fragment or variant thereof, and an unmodified Furin domain 2 of an R-spondin polypeptide (e.g., a human R-spondin). While in certain embodiments, a modified Furin domain 2 having reduced binding affinity to LGR4-6 as compared to the corresponding wild-type Furin domain 2 is more desirable to increase the specificity of tissue targeting, in particular embodiments, the unmodified Furin domain 2 combined with the targeting module has improved tissue targeting over wild-type R-spondin without targeting module, and has utility in certain contexts.

In certain embodiments, the action module comprises a wild-type or modified R-spondin Furin domain 1, e.g., from any of R-spondin-1, -2, -3, -4, optionally human R-spondins-1, -2, -3 or -4. In particular embodiments, the action module comprises the R-spondin Furin 1 domain and a wild-type or modified R-spondin Furin 2 domain, e.g., from any of R-spondin-1, -2, -3, -4, optionally human R-spondins-1, -2, -3 or -4. In particular embodiments, the action module comprises the first R-spondin Furin 1 domain and a second wild-type or modified R-spondin Furin 1 domain, e.g., from any of R-spondin-1, -2, -3, -4, optionally human R-spondins-1, -2, -3 or -4. In particular embodiments, the modified Furin domain 2 has comparable binding affinity to LGR4-6 or a binding affinity to LGR4-6 of less than 80%, less than 50%, less than 20%, or less than 10% the binding of the corresponding wild-type Furin domain 2, e.g., in the context of the full length R-spondin protein.

In certain embodiments, the action module comprises an antibody or antigen-binding fragment thereof that specifically binds ZNRF3 and/or RNF43. In particular embodiments, the action module comprises an antibody or antigen-binding fragment thereof that binds to human RNF43 (hRNF43, NCBI reference sequence XP_011523257.1, residues 44-198; SEQ ID NO:43-44) or human ZNRF3 (hZNRF3; NCBI reference sequence NP_001193927.1, residues 56-219; SEQ ID NO:45-46). In particular embodiments, the action module is an antibody or an antigen-binding fragment thereof, comprising: a) CDRH1, CDRH2 and CDRH3 sequences set forth for any of the antibodies of Table 2A; and/or b) CDRL1, CDRL2 and CDRL3 sequences set forth for any of the antibodies of Table 2A, or a variant of said antibody, or antigen-binding fragment thereof, comprising one or more amino acid modifications, wherein said variant comprises less than 8 amino acid substitutions in said CDR sequences. In particular embodiments, the isolated antibody, or antigen-binding fragment thereof comprises a heavy chain variable region, light chain, nanobody, or scFv sequence comprising an amino acid sequence having at least 90% identity to the heavy chain variable region, light chain, nanobody or scFv of any of these antibodies, e.g., any of SEQ ID NOs:78-154 or 165-170. VL indicates variable light chain, and VH indicates variable heavy chain sequences.

TABLE 2A

Clone IDs and CDR sequences of binders against hRNF43/ZNRF3

| Clone ID | Specificity | CDRH1 | SID NO. | CDRH2 | SID NO. | CDRH3 | SID NO. |
|---|---|---|---|---|---|---|---|
| 020S-E06 | RNF43 | YTFTGYYMH | 329 | GIINPSGGSTSYA | 349 | CARGRQGVWDYW | 393 |
| 020S-F06 | RNF43 | YTFTSYYLH | 338 | GWMNPNSGNTGYA | 366 | CARGDFWSGYYPYYYYYGMDVW | 388 |
| 028S-B01 | RNF43 | YTFTAYYMH | 327 | GIINPNGGRTTYA | 345 | CARSFGVAGTLDYW | 404 |
| 028S-E01 | RNF43 | YTFTSYDIN | 336 | GVINPGGSDTTYA | 354 | CARDGYYYGMDVW | 379 |
| 028S-G01 | RNF43 | YTFTNYYMH | 332 | GWINPHSGGTNYA | 356 | CAREDYNWNDGWFDPW | 386 |
| 028S-H01 | RNF43 | GTFSNYAIS | 318 | GWINPNSGGTNYA | 358 | CAKDSGYCSSTSCYDGGYFDLW | 376 |
| 028S-B02 | RNF43 | FTFSSYAMH | 312 | SAISGSGTYYA | 372 | CARDQGHDYGDYEIDYW | 383 |
| 028S-C02 | RNF43 | YTFTNYYMH | 332 | GIINPSGGSANYA | 348 | CARDPVRGISAFDYW | 382 |
| 024S-A02 | RNF43, ZNRF3 | YTFTSYAMH | 335 | GWINAGNGNTKYS | 355 | CARDLMVRGGPPFDYW | 381 |
| 028S-D02 | ZNRF3 | DSVSSNSAAWY | 306 | GRTYYRSKWYHDYA | 353 | CARVVRAVDAFDIW | 407 |
| 020S-H06 | ZNRF3 | YTFTSYYMH | 339 | GWMNPNSGNTGYA | 366 | CARGRVVRGVIISYGMDVW | 397 |
| 020S-A07 | ZNRF3 | DTFTGYYIH | 307 | GGIIPIFDAATYA | 342 | CTRARGQRSGYSYFDLW | 409 |
| 020S-B07 | ZNRF3 | GTFSTSGIT | 321 | GWMNPNTGGIKYS | 367 | CAKSRALKGSYTSW | 377 |
| 020S-D07 | RNF43, ZNRF3 | GTFSNTDIN | 317 | GGIIPIFGTANYA | 344 | CVGGRSGWIWYFDLW | 410 |
| 020S-E07 | ZNRF3 | GTFSNYSLS | 319 | GIINPRRGSTRYA | 347 | CARDGLGVDAFDIW | 378 |
| 020S-F07 | RNF43, ZNRF3 | FTFSNYAMG | 311 | SYISRSSSTIYYA | 697 | CARRDGYNWGYW | 402 |
| 028S-H02 | ZNRF3 | YTFTNYYMH | 332 | GRIKPNSGNTGYA | 351 | CARGRRSRGSSSLGYYYYMDVW | 395 |
| 028S-C03 | ZNRF3 | YTFSRYFMH | 326 | GWINPNSGGTRYA | 359 | CARDQKGKSSSWFRFDPW | 384 |
| 028S-A04 | ZNRF3 | YTFTNYKMH | 331 | GKINPSGGSTSYA | 350 | CARSGAGMWYFDLW | 405 |
| 028S-B04 | ZNRF3 | YTFRRYPMH | 325 | GIINPSGGSTSYA | 349 | CARDKVGAIDYW | 380 |
| 028S-C04 | ZNRF3 | YTFTRYYMH | 334 | GIINPSGGSTSYA | 349 | CARGGSGWLDYW | 391 |
| 028S-D04 | ZNRF3 | GTFSSYAIS | 320 | GRISPNRGGTKYA | 352 | CARDSWLRGAWGYW | 385 |
| 028S-E04 | ZNRF3 | FTFNNFGMS | 310 | SGISASGRNTYYA | 373 | CARETRHGSDYW | 387 |
| 028S-H04 | ZNRF3 | YTFIGYYMH | 324 | GWVNPKNGHTGYA | 368 | CAKDLEHTGYSSGWAGFDYW | 375 |
| 028S-B06 | ZNRF3 | YRFTNYYMH | 322 | GWISPNSGATNYA | 363 | CARGGRTTVTTMAYW | 390 |

TABLE 2A-continued

Clone IDs and CDR sequences of binders against hRNF43/ZNRF3

| Clone ID | Specificity | CDRH1 | SID NO. | CDRH2 | SID NO. | CDRH3 | SID NO. |
|---|---|---|---|---|---|---|---|
| 028S-G06 | ZNRF3 | FAFSNFAMI | 308 | SAISGSGGSTYYA | 370 | CARLRANYGMDVW | 400 |
| 028S-B07 | ZNRF3 | YTFTEYYMH | 328 | GWMNPNSGHAGSA | 365 | CARGRRSGLSPPAYW | 394 |
| 028S-H07 | ZNRF3 | YTFTNYGIS | 330 | GWISADNGNTNYA | 362 | CARGRSGNWKFW | 396 |
| 028S-D08 | ZNRF3 | YTFTSYYMH | 339 | GWINPNSGNTKYA | 360 | CARGSNGMDVW | 399 |
| 028S-E08 | ZNRF3 | FSFSNYAMS | 309 | SAISGSGRTTYYA | 371 | CARRTSSFSLW | 403 |
| 028S-F08 | ZNRF3 | GTFSNYAIS | 318 | GGIIPIFDATNYA | 343 | CARRQYSGYDTHFDYW | 401 |
| 028S-A09 | ZNRF3 | YRFTSYYLH | 323 | GWMNPKSGGTNYA | 364 | CARGGRSYGYWYFDLW | 389 |
| 028S-D09 | ZNRF3 | YTFTRHYMH | 333 | GIINPSGGSTSYA | 349 | CARGSLGYFDLW | 398 |
| 028S-E10 | ZNRF3 | YTFTSYYMH | 339 | GWINPNTGGTKSA | 361 | CARVLRGSLGFDYW | 406 |
| 028S-G10 | ZNRF3 | YTFTSYGVS | 337 | GIINPRGGSTSYA | 346 | CARYSSSWSWPFDYW | 408 |
| 028S-A11 | ZNRF3 | GTFSGYYMH | 316 | GWINPNRGGTSYA | 357 | CARGMYSSSWLRYW | 392 |
| SC-01 | RNF43 | GFNIKDT | 314 | DPANGK | 340 | GGGYYGMDY | 411 |
| SC-02 | RNF43 | GFNIKDD | 313 | DPENGD | 341 | SRTTALDY | 412 |
| NV-01 | ZNRF3 | GFTFSDY | 315 | KSKTDGGI | 369 | AIYYLEAFDV | 374 |
| 020S-E06 | RNF43 | RSSQSIRTYLN | 439 | AASTLQS | 448 | CQQANSFPITF | 473 |
| 020S-F06 | RNF43 | RVSQGISSYLN | 441 | AASTLQS | 448 | CQQSYGAPLTF | 479 |
| 028S-B01 | RNF43 | RSSQSLLHSNGYNYLD | 440 | DASNLET | 451 | CMQTLHTPYTF | 472 |
| 028S-E01 | RNF43 | KSSQSVLYSSNNKNYLA | 414 | WASTRES | 465 | CQQYYSDPITF | 498 |
| 028S-G01 | RNF43 | RASENIHKYLN | 417 | AASSLQS | 447 | CQQGYSTPYTF | 477 |
| 028S-H01 | RNF43 | RASQNIYDWLA | 426 | DASNLET | 451 | CQQTYSTPFTF | 492 |
| 028S-B02 | RNF43 | RSSQSLLHSNGYNYLD | 440 | LGSYRAS | 462 | CMQALQTPLTF | 468 |
| 028S-C02 | RNF43 | RASQSIRSYLN | 428 | AASSLQS | 447 | CLQDYDYPLTF | 467 |
| 024S-A02 | RNF43, ZRNF3 | RASQSVSSSYLA | 437 | GASSRAT | 456 | CQQYGSSPRTF | 494 |
| 028S-D02 | ZNRF3 | RASQSVNSRYLA | 434 | GASSRAT | 456 | CQQYGSSRLTF | 495 |
| 020S-H06 | ZNRF3 | RASQSVSSSNLA | 436 | ATSTRAT | 450 | CQQYGSSPITF | 493 |
| 020S-A07 | ZNRF3 | RASQNIRSWLA | 425 | DASSLQR | 454 | CQQSYSTPPTF | 487 |

TABLE 2A-continued

Clone IDs and CDR sequences of binders against hRNF43/ZNRF3

| Clone ID | Specificity | CDRH1 | SID NO. | CDRH2 | SID NO. | CDRH3 | SID NO. |
|---|---|---|---|---|---|---|---|
| 020S-B07 | ZNRF3 | RAGQSISRFLN | 416 | AASSLQS | 447 | CQQSYSTPYTF | 489 |
| 020S-D07 | RNF43, ZNRF3 | RASQSISRWLA | 429 | DASSLET | 452 | CQQAYSFPWTF | 475 |
| 020S-E07 | ZNRF3 | QASQDISRYLN | 415 | AASSLQS | 447 | CQQSYSRPFTF | 484 |
| 020S-F07 | RNF43, ZNRF3 | RASQDISNSLN | 419 | AASTLQS | 448 | CQQSYSPPHTF | 483 |
| 028S-H02 | ZNRF3 | RASQFISTYLN | 422 | DASSLPS | 453 | CQQSYSTSWTF | 490 |
| 028S-C03 | ZNRF3 | RSSQSLLHSNGYNYLD | 440 | LGSNRAS | 461 | CMQSLEAPLAF | 471 |
| 028S-A04 | ZNRF3 | RASQDIYRYLN | 421 | AASSLHS | 445 | CQQSYTTPITF | 491 |
| 028S-B04 | ZNRF3 | RASQGISNYLA | 424 | AASSLQR | 446 | CQQSYSTPLTF | 486 |
| 028S-C04 | ZNRF3 | RASQSISTWLA | 432 | AASTLQS | 448 | CQQSYSSPLTF | 485 |
| 028S-D04 | ZNRF3 | RASQSISRWLA | 429 | AASTLQS | 448 | CQQSFSTPYTF | 478 |
| 028S-E04 | ZNRF3 | TSSQSVLHSSNKKNYLA | 443 | WASTRAS | 464 | CQQYHSTPYTF | 496 |
| 028S-H04 | ZNRF3 | KSSQSVLYSSNNKNYLA | 414 | WASTRES | 465 | CQQYYSTPLTF | 499 |
| 028S-B06 | ZNRF3 | RSSQSLLHSNGYNYLD | 440 | GASSLQS | 455 | CMQGTHWPRTF | 469 |
| 028S-G06 | ZNRF3 | RASQSISSYLN | 431 | AASSLQS | 447 | CQQSYRTPYTF | 481 |
| 028S-B07 | ZNRF3 | RASQSVSASLA | 435 | GASTRAT | 457 | CHQYFSPPMTF | 466 |
| 028S-H07 | ZNRF3 | RASQYIGSYLN | 438 | AASTLQS | 448 | CQQSYSPPFTF | 482 |
| 028S-D08 | ZNRF3 | RSSQSLLHSNGYNYLD | 440 | KASSLES | 458 | CMQGTHWPYAF | 470 |
| 028S-E08 | ZNRF3 | RASQSINNWLA | 427 | KASSLES | 458 | CQQANTFPITF | 474 |
| 028S-F08 | ZNRF3 | KSSQSVLYSSNNKNYLA | 414 | WASTRES | 465 | CQQYYSTPPTF | 500 |
| 028S-A09 | ZNRF3 | RASQSVDSSYLA | 433 | AASARAA | 444 | CQQYYRSPPTF | 497 |
| 028S-D09 | ZNRF3 | RASQSISSWLA | 430 | AASSLQS | 447 | CQQSYSTPLTF | 486 |
| 028S-E10 | ZNRF3 | RASQDISRYLA | 420 | AASTVES | 449 | CQQSYRSPYTF | 480 |
| 028S-G10 | ZNRF3 | RASQGISNNLN | 423 | AASTLQS | 448 | CQQSYSTPTF | 488 |
| 028S-A11 | ZNRF3 | RASQGISNYLA | 424 | AASSLQS | 447 | CQQGSSFPLTF | 476 |
| SC-01 | RNF43 | RASESVDSYGNSFMH | 418 | LASNLES | 459 | QQNNEDPLT | 502 |

TABLE 2A-continued

Clone IDs and CDR sequences of binders against hRNF43/ZNRF3

| Clone ID | Specificity | CDRH1 | SID NO. | CDRH2 | SID NO. | CDRH3 | SID NO. |
|---|---|---|---|---|---|---|---|
| SC-02 | RNF43 | KASQSVRPAVA | 413 | LASNRHT | 460 | LQHWNYPYT | 501 |
| NV-01 | ZNRF3 | SGDSLGSYYVH | 442 | RNKQRPS | 463 | QTYDWMYSSRV | 503 |

TABLE 2B

Description of Sequence Identifiers

| SID NO: | Brief Description | Sequence |
|---|---|---|
| 78 | 020S-E06 VL | DIQMTQSPSSLSASVGDRVTITCRSSQSIRTYLNWYQQKPGKAPKLLIY AASTLQSGVPSRFSGSGSGTDFTLTISSLQPEDFATYYCQQANSFPITFG GGTKVEIK |
| 79 | 020S-E06 VH | QVQLVQSGAEVKKPGASVKVSCKASGYTFTGYYMHWVRQAPGQGL EWMGIINPSGGSTSYAQKFQGRVTMTRDTSTSTVYMELSSLRSEDTA VYYCARGRQGVWDYWGRGTLVTVSS |
| 80 | 020S-F06 VL | DIQMTQSPSSLSASVGDRVTITCRVSQGISSYLNWYQQKPGKAPKLLI YAASTLQSGVPSRFSGSGSGTDFTLTISSLQPEDFATYYCQQSYGAPLT FGQGTKVEIK |
| 81 | 020S-F06 VH | QVQLVQSGAEVKKPGASVKVSCKASGYTFTSYYLHWVRQAPGQGLE WMGWMNPNSGNTYAQNFQGRVTMTRDTSTSTVYMELSSLRSEDT AVYYCARGDFWSGYYPYYYYYGMDVWGQGTTVTVSS |
| 82 | 028S-B01 VL | DIVMTQSPLSLPVTPGEPASISCRSSQSLLHSNGYNYLDWYLQKPGQS PQLLIYDASNLETGVPDRFSGSGSGTDFTLKISRVEAEDVGVYYCMQT LHTPYTFGQGTKLEIK |
| 83 | 028S-B01 VH | QVQLVQSGAEVKKPGASVKVSCKASGYTFTAYYMHWVRQAPGQGL EWMGIINPNGGRTTYAQKFQGRVTMTRDTSTSTVYMELSSLRSEDTA VYYCARSFGVAGTLDYWGQGTLVTVSS |
| 84 | 028S-E01 VL | DIVMTQSPDSLAVSLGERATINCKSSQSVLYSSNNKNYLAWYQQKPG QPPKLLIYWASTRESGVPDRFSGSGSGTDFTLTISSLQAEDVAVYYCQ QYYSDPITFGQGTRLEIK |
| 85 | 028S-E01 VH | QVQLVQSGAEVKKPGSSVKVSCKASGYTFTSYDINWVRQAPGQGLE WMGVINPGGSDTTYAQKFQGRVTITADESTSTAYMELSSLRSEDTAV YYCARDGYYYGMDVWGQGTTVTVSS |
| 86 | 028S-G01 VL | DIQMTQSPSSLSASVGDRVTITCRASENIHKYLNWYQQKPGKAPKLLI YAASSLQSGVPSRFSGSGSGTDFTLTISSLQPEDFATYYCQQGYSTPYT FGQGTKLEIK |
| 87 | 028S-G01 VH | QVQLVQSGAEVKKPGASVKVSCKASGYTFTNYYMHWVRQAPGQGL EWMGWINPHSGGTNYAQKFQGRVTMTRDTSTSTVYMELSSLRSEDT AVYYCAREDYNWNDGWFDPWGQGTLVTVSS |
| 88 | 028S-H01 VL | DIQMTQSPSSLSASVGDRVTITCRASQNIYDWLAWYQQKPGKAPKLLI YDASNLETGVPSRFSGSGSGTDFTLTISSLQPEDFATYYCQQTYSTPFT FGPGTKVDIK |
| 89 | 028S-H01 VH | QVQLVQSGAEVKKPGASVKVSCKASGGTFSNYAISWVRQAPGQGLE WMGWINPNSGGTNYAQKFQGRVTMTRDTSTSTVYMELSSLRSEDTA VYYCAKDSGYCSSTSCYDGGYFDLWGRGTLVTVSS |
| 90 | 028S-B02 VL | DIVMTQSPLSLPVTPGEPASISCRSSQSLLHSNGYNYLDWYLQKPGQS PQLLIYLGSYRASGVPDRFSGSGSGTDFTLKISRVEAEDVGVYYCMQA LQTPLTFGGGTKVEIK |
| 91 | 028S-B02 VH | EVQLVESGGGLVKPGGSLRLSCAASGFTFSSYAMHWVRQAPGKGLE WVSAISGSGTYYADSVKGRFTISRDDSKNTLYLQMNSLKTEDTAVYY CARDQGHDYGDYEIDYWGQGTLVTVSS |
| 92 | 028S-C02 VL | DIQMTQSPSSLSASVGDRVTITCRASQSIRSYLNWYQQKPGKAPKLLI YAASSLQSGVPSRFSGSGSGTDFTLTISSLQPEDFATYYCLQDYDYPLT FGGGTKVEIK |

TABLE 2B-continued

Description of Sequence Identifiers

| SID NO: | Brief Description | Sequence |
|---|---|---|
| 93 | 028S-C02 VH | QVQLVQSGAEVKKPGASVKVSCKASGYTFTNYYMHWVRQAPGQGL EWMGIINPSGGSANYAQKFQGRVTMTRDTSTSTVYMELSSLRSEDTA VYYCARDPVRGISAFDYWGQGTLVTVSS |
| 94 | 024S-D04 VHH | DVQLVESGGGLVQPGGSLRLSCAASGFTFSSYAMSWVRQAPGKGLE WVSVINSGGGSTSYAESVKGRFIISRDNAKNTLYLQMNSLKPEDTAV YYCARGTYYSGSYYYPALYYGMDYWGKGTQVTVSS |
| 95 | 024S-A02 VL | EIVLTQSPGTLSLSPGERATLSCRASQSVSSSYLAWYQQKPGQAPRLLI YGASSRATGIPDRFSGSGSGTDFTLTISRLEPEDFAVYYCQQYGSSPRT FGQGTKVEIK |
| 96 | 024S-A02 VH | EVQLVQSGAEVKKPGASVKVSCKASGYTFTSYAMHWVRQAPGQRLE WMGWINAGNGNTKYSQTFQGRVTITRDTSASTAYMELSSLRSEDTA VYYCARDLMVRGGPPFDYWGQGTLVTVSS |
| 97 | 028S-D02 VL | ETTLTQSPGTLSLSPGERATLSCRASQSVNSRYLAWYQQKPGQAPRLL IYGASSRATGIPDRLTGSGSGTDFTLTISRLEPEDFAVYYCQQYGSSRL TFGGGTKVEIK |
| 98 | 028S-D02 VH | QVQLQQSGPGLVKPSQTLSLTCAISGDSVSSNSAAWYWIRQSPSRGLE WLGRTYYRSKWYHDYAVSVKSRITINADTSKNQFSLQLNSVTPEDTA VYYCARVVRAVDAFDIWGQGTMVTVSS |
| 99 | 020S-H06 VL | EIVMTQSPATLSVSPGERATLSCRASQSVSSSNLAWYQQKPGQAPRLL IYATSTRATGIPARFSGSGSGTEFTLTISSLQSEDFAVYYCQQYGSSPIT FGGGTKVEIK |
| 100 | 020S-H06 VH | QVQLVQSGAEVKKPGASVKVSCKASGYTFTSYYMHWVRQAPGQGL EWMGWMNPNSGNTGYAQKFQGRVTMTRDTSTSTVYMELSSLRSED TAVYYCARGRVVRGVIISYGMDVWGQGTTVTVSS |
| 101 | 020S-A07 VL | DIQMTQSPSSLSASVGDRVTITCRASQNIRSWLAWYQQKPGKAPKLLI YDASSLQRGVPSRFSGSGSGTDFTLTISSLQPEDFATYYCQQSYSTPPT FGQGTKLEIK |
| 102 | 020S-A07 VH | QVQLVQSGAEVKKPGSSVKVSCKASGDTFTGYYIHWVRQAPGQGLE WMGGIIPIFDAATYAQKFQGRVTITADESTSTAYMELSSLRSEDTAVY YCTRARGQRSGYSYFDLWGRGTLVTVSS |
| 103 | 020S-B07 VL | DIQMTQSPSSLSASVGDRVTITCRAGQSISRFLNWYQQKPGKAPKLLI YAASSLQSGVPSRFSGSGSGTDFTLTISSLQPEDFATYYCQQSYSTPYT FGQGTKLEIK |
| 104 | 020S-B07 VH | QVQLVQSGAEVKKPGASVKVSCKASGGTFSTSGITWVRQAPGQGLE WMGWMNPNTGGIKYSQKFQGRVTMTRDTSTSTVYMELSSLRSEDTA VYYCAKSRALKGSYTSWGQGTLVTVSS |
| 105 | 020S-D07 VL | DIQMTQSPSSLSASVGDRVTITCRASQSISRWLAWYQQKPGKAPKLLI YDASSLETGVPSRFSGSGSGTDFTLTISSLQPEDFATYYCQQAYSFPWT FGQGTKVEIK |
| 106 | 020S-D07 VH | QVQLVQSGAEVKKPGSSVKVSCKASGGTFSNTDINWVRQAPGQGLE WMGGIIPIFGTANYAQKFQGRVTITADESTSTAYMELSSLRSEDTAVY YCVGGRSGWIWYFDLWGRGTLVTVSS |
| 107 | 020S-E07 VL | DIQMTQSPSSLSASVGDRVTITCQASQDISRYLNWYQQKPGKAPKLLI YAASSLQSGVPSRFSGSGSGTDFTLTISSLQPEDFATYYCQQSYSRPFT FGPGTKVDIK |
| 108 | 020S-E07 VH | QVQLVQSGAEVKKPGASVKVSCKASGGTFSNYSLSWVRQAPGQGLE WMGIINPRRGSTRYAQNFQGRVTMTRDTSTSTVYMELSSLRSEDTAV YYCARDGLGVDAFDIWGQGTMVTVSS |
| 109 | 020S-F07 VL | DIQMTQSPSSLSASVGDRVTITCRASQDISNSLNWYQQKPGKAPKLLI YAASTLQSGVPSRFSGSGSGTDFTLTISSLQPEDFATYYCQQSYSPPHT FGGGTKVEIK |
| 110 | 020S-F07 VH | EVQLLESGGGLVQPGGSLRLSCAASGFTFSNYAMGWVRQAPGKGLE WVSYISRSSSTIYYADSVKGRFTISRDNSKNTLYLQMNSLRAEDTAVY YCARRRDGYNWGYWGQGTLVTVSS |
| 111 | 028S-H02 VL | DIQMTQSPSSLSASVGDRVTITCRASQFISTYLNWYQQKPGKAPKLLIY DASSLPSGVPSRFSGSGSGTDFTLTISSLQPEDFATYYCQQSYSTSWTF GQGTKVEIK |

TABLE 2B-continued

Description of Sequence Identifiers

| SID NO: | Brief Description | Sequence |
|---|---|---|
| 112 | 028S-H02 VH | QVQLVQSGAEVKKPGASVKVSCKASGYTFTNYYMHWVRQAPGQGL EWMGRIKPNSGNTGYAQKFQGRVTMTRDTSTSTVYMELSSLRSEDT AVYYCARGRRSRGSSSLGYYYYMDVWGKGTTVTVSS |
| 113 | 028S-C03 VL | DIVMTQSPLSLPVTPGEPASISCRSSQSLLHSNGYNYLDWYLQKPGQS PQLLIYLGSNRASGVPDRFSGSGSGTDFTLKISRVEAEDVGVYYCMQS LEAPLAFGQGTKLEIK |
| 114 | 028S-C03 VH | QVQLVQSGAEVKKPGASVKVSCKASGYTFSRYFMHWVRQAPGQGL EWMGWINPNSGGTRYAQNLQGRVTMTRDTSTSTVYMELSSLRSEDT AVYYCARDQKGKSSSWFRFDPWGQGTLVTVSS |
| 115 | 028S-A04 VL | DIQMTQSPSSLSASVGDRVTITCRASQDIYRYLNWYQQKPGKAPKLLI FAASSLHSGVPSRFSGSGSGTDFTLTISSLQPEDFATYYCQQSYTTPITF GQGTKVEIK |
| 116 | 028S-A04 VH | QVQLVQSGAEVKKPGASVKVSCKASGYTFTNYKMHWVRQAPGQGL EWMGKINPSSGSTSYAQKFQGRVTMTRDTSTSTVYMELSSLRSEDTA VYYCARSGAGMWYFDLWGRGTLVTVSS |
| 117 | 028S-B04 VL | DIQMTQSPSSLSASVGDRVTITCRASQGISNYLAWYQQKPGKAPKLLI YAASSLQRGVPSRFSGSGSGTDFTLTISSLQPEDFATYYCQQSYSTPLT FGGGTKVEIK |
| 118 | 028S-B04 VH | QVQLVQSGAEVKKPGASVKVSCKASGYTFRRYPMHWVRQAPGQGL EWMGIINPSGGSTSYAQKFQGRVTMTRDTSTSTVYMELSSLRSEDTA VYYCARDKVGAIDYWGQGTLVTVSS |
| 119 | 028S-C04 VL | DIQMTQSPSSLSASVGDRVTITCRASQSISTWLAWYQQKPGKAPKLLI YAASTLQSGVPSRFSGSGSGTDFTLTISSLQPEDFATYYCQQSYSSPLT FGGGTKVEIK |
| 120 | 028S-C04 VH | QVQLVQSGAEVKKPGASVKVSCKASGYTFTRYYMHWVRQAPGQGL EWMGIINPSGGSTSYAQKFQGRVTMTRDTSTSTVYMELSSLRSEDTA VYYCARGGSGWLDYWGQGTLVTVSS |
| 121 | 028S-D04 VL | DIQMTQSPSSLSASVGDRVTITCRASQSISRWLAWYQQKPGKAPKLLI YAASTLQSGVPSRFSGSGSGTDFTLTISSLQPEDFATYYCQQSFSTPYT FGQGTKVEIK |
| 122 | 028S-D04 VH | QVQLVQSGAEVKKPGASVKVSCKASGGTFSSYAISWVRQAPGQGLE WMGRISPNRGGTKYAQKFQGRVTMTRDTSTSTVYMELSSLRSEDTA VYYCARDSWLRGAWGYWGQGTLVTVSS |
| 123 | 028S-E04 VL | DIVMTQSPDSLAVSLGERATINCTSSQSVLHSSNKKNYLAWYQQKPG QPPKLLIYWASTRASGVPDRFSGSGSGTDFTLTISSLQAEDVAVYYCQ QYHSTPYTFGQGTKVEIK |
| 124 | 028S-E04 VH | EVQLLESGGGLVQPGGSLRLSCAASGFTFNNFGMSWVRQAPGKGLE WVSGISASGRNTYYADSVKGRFTISRDNSKNTLYLQMNSLRAEDRAV YYCARETRHGSDYWGQGTLVTVSS |
| 125 | 028S-H04 VL | DIVMTQSPDSLAVSLGERATINCKSSQSVLYSSNNKNYLAWYQQKPG QPPKLLIYWASTRESGVPDRFSGSGSGTDFTLTISSLQAEDVAVYYCQ QYYSTPLTFGGGTKVEIK |
| 126 | 028S-H04 VH | QVQLVQSGAEVKKPGASVKVSCKASGYTFIGYYMHWVRQAPGQGL EWLGWVNPKNGHTGYAQKFQGRVTMTRDTSTSTVYMELSSLRSEDT AVYYCAKDLEHTGYSSGWAGFDYWGQGTLVTVSS |
| 127 | 028S-B06 VL | DIVMTQSPLSLPVTPGEPASISCRSSQSLLHSNGYNYLDWYLQKPGQS PQLLIYGASSLQSGVPDRFSGSGSGTDFTLKISRVEAEDVGVYYCMQG THWPRTFGQGTKVDIK |
| 128 | 028S-B06 VH | QVQLVQSGAEVKKPGASVKVSCKASGYRFTNYYMHWVRQAPGQGL EWMGWISPNSGATNYAQNFQGRVTMTRDTSTSTVYMELSSLRSEDT AVYYCARGGRTTVTTMAYWGQGTLVTVSS |
| 129 | 028S-G06 VL | DIQMTQSPSSLSASVGDRVTITCRASQSISSYLNWYQQKPGKAPKLLIY AASSLQSGVPSRFSGSGSGTDFTLTISSLQPEDFATYYCQQSYRTPYTF GQGTKLEIK |

TABLE 2B-continued

Description of Sequence Identifiers

| SID NO: | Brief Description | Sequence |
|---|---|---|
| 130 | 028S-G06 VH | EVQLLESGGGLVQPGGSLRLSCAASGFAFSNFAMIWVRQAPGKGLEW VSAISGSGGSTYYADSVKGRFTISRDNSKNTLYLQMNSLRAEDTAVY YCARLRANYGMDVWGQGTTVTVSS |
| 131 | 028S-B07 VL | EIVMTQSPATLSVSPGERATLSCRASQSVSASLAWYQQKPGQAPRLLI YGASTRATGIPARFSGSGSGTEFTLTISSLQSEDFAVYYCHQYFSPPMT FGQGTRLEIK |
| 132 | 028S-B07 VH | QVQLVQSGAEVKKPGASVKVSCKASGYTFTEYYMHWVRQAPGQGL EWMGWMNPNSGHAGSAQKFQGRVTMTRDTSTSTVYMELSSLRSED TAVYYCARGRRSGLSPPAYWGQGTLVTVSS |
| 133 | 028S-H07 VL | DIQMTQSPSSLSASVGDRVTITCRASQYIGSYLNWYQQKPGKAPKLLI YAASTLQSGVPSRFSGSGSGTDFTLTISSLQPEDFATYYCQQSYSPPFT FGQGTKVEIK |
| 134 | 028S-H07 VH | QVQLVQSGAEVKKPGASVKVSCKASGYTFTNYGISWVRQAPGQGLE WMGWISADNGNTNYAQKFQGRVTMTRDTSTSTVYMELSSLRSEDTA VYYCARGRSGNWKFWGQGTLVTVSS |
| 135 | 028S-D08 VL | DIVMTQSPLSLPVTPGEPASISCRSSQSLLHSNGYNYLDWYLQKPGQS PQLLIYKASSLESGVPDRFSGSGSGTDFTLKISRVEAEDVGVYYCMQG THWPYAFGQGTRLEIK |
| 136 | 028S-D08 VH | QVQLVQSGAEVKKPGASVKVSCKASGYTFTSYYMHWVRQAPGQGL ELMGWINPNSGNTKYAQKFQGRVTMTRDTSTSTVYMELSSLRSEDTA VYYCARGSNGMDVWGQGTTVTVSS |
| 137 | 028S-E08 VL | DIQMTQSPSSLSASVGDRVTITCRASQSINNWLAWYQQKPGKAPKLLI YKASSLESGVPSRFSGSGSGTDFTLTISSLQPEDFATYYCQQANTFPITF GQGTRLEIK |
| 138 | 028S-E08 VH | EVQLLESGGGLVQPGGSLRLSCAASGFSFSNYAMSWVRQAPGKGLE WVSAISGSGRTTYYADSVKGRFTISRDNSKNTLYLQMNSLRAEDTAV YYCARRTSSFSLWGQGTLVTVSS |
| 139 | 028S-F08 VL | DIVMTQSPDSLAVSLGERATINCKSSQSVLYSSNNKNYLAWYQQKPG QPPKWYWASTRESGVPDRFSGSGSGTDFTLTISSLQAEDVAVYYCQ QYYSTPPTFGQGTKLEIK |
| 140 | 028S-F08 VH | QVQLVQSGAEVKKPGSSVKVSCKASAGTFSNYAISWVRQAPGQGLE WMGGIIPIFDATNYAQKFQGRVTITADESTSTAYMELSSLRSEDTAVY YCARRQYSGYDTHFDYWGQGTLVTVSS |
| 141 | 028S-A09 VL | EIVMTQSPATLSVSPGERATLSCRASQSVDSSYLAWYQQKPGQAPRL LIYAASARAAGIPARFSGSGSGTEFTLTISSLQSEDFAVYYCQQYYRSP PTFGQGTRLEIK |
| 142 | 028S-A09 VH | QVQLVQSGAEVKKPGASVKVSCKASGYRFTSYYLHWVRQAPGQGLE WMGWMNPKSGGTNYAQKFQGRVTMTRDTSTSTVYMELSSLRSEDT AVYYCARGGRSYGYWYFDLWGRGTLVTVSS |
| 143 | 028S-D09 VL | DIQMTQSPSSLSASVGDRVTITCRASQSISSWLAWYQQKPGKAPKLLI YAASSLQSGVPSRFSGSGSGTDFTLTISSLQPEDFATYYCQQSYSTPLT FGGGTKVEIK |
| 144 | 028S-D09 VH | QVQLVQSGAEVKKPGASVKVSCKASGYTFTRHYMHWVRQAPGQGL EWMGIINPSGGSTSYAQKFQGRVTMTRDTSTSTVYMELSSLRSEDTA VYYCARGSLGYFDLWGRGTLVTVSS |
| 145 | 028S-E10 VL | DIQMTQSPSSLSASVGDRVTITCRASQDISRYLAWYQQKPGKAPKLLI YAASTVESGVPSRFSGSGSGTDFTLTI?SLQPEDFATYYCQQSYRSPYT FGQGTKLEIK |
| 146 | 028S-E10 VH | QVQLVQSGAEVKKPGASVKVSCKASGYTFTSYYMHWVRQAPGQGL EWMGWINPNTGGTKSAQKFQGRVTMTRDTSTSTVYMELSSLRSEDT AVYYCARVLRGSLGFDYWGQGTLVTVSS |
| 147 | 028S-G10 VL | DIQMTQSPSSLSASVGDRVTITCRASQGISNNLNWYQQKPGKAPKLLI YAASTLQSGVPSRFSGSGSGTDFTLTISSLQPEDFATYYCQQSYSTPTF GQGTKVEIK |
| 148 | 028S-G10 VH | QVQLVQSGAEVKKPGASVKVSCKASGYTFTSYGVSWVRQAPGQGLE WMGIINPRGGSTSYAQNFQGRVTMTRDTSTSTVYMELSSLRSEDTAV YYCARYSSSWSWPFDYWGQGTLVTVSS |

TABLE 2B-continued

Description of Sequence Identifiers

| SID NO: | Brief Description | Sequence |
|---|---|---|
| 149 | 028S-A11 VL | DIQMTQSPSSLSASVGDRVTITCRASQGISNYLAWYQQKPGKAPKLLI YAASSLQSGVPSRFSGSGSGTDFTLTISSLQPEDFATYYCQQGSSFPLT FGQGTKVDIK |
| 150 | 028S-A11 VH | QVQLVQSGAEVKKPGASVKVSCKASGGTFSGYYMHWVRQAPGQGL EWMGWINPNRGGTSYAQNFQGRVTMTRDTSTSTVYMELSSLRSEDT AVYYCARGMYSSSWLRYWGQGTLVTVSS |
| 165 | SC-01 VL | DIVMTQSPDSLAVSLGERATINCRASESVDSYGNSFMHWYQQKPGQP PKLLIYLASNLESGVPDRFSGSGSGTDFTLTISSLQAEDVAVYYCQQN NEDPLTFGQGTKVEIK |
| 166 | SC-01 VH | QVQLVQSGAEVKKPGASVKVSCKASGFNIKDTYIHWVRQAPGQGLE WMGRIDPANGKANYDPKFQGRVTMTRDTSTSTFYMELSSLRSEDTA VYYCALGGGYYGMDYWGQGTLVTVSS |
| 167 | SC-02 VL | DIVMTQSQKFMSTSVGDRVSITCKASQSVRPAVAWYQQKPGQSPKAL IYLASNRHTGVPDRFTGSGSGTDFTLTISNVQSEDLADYFCLQHWNYP YTFGGGTKLEIK |
| 168 | SC-02 VH | EVQLQQSGAELVRPGASVKLSCTASGFNIKDDYIHWVKQRPEQGLEW IGWIDPENGDTKYASKFPGKATMTADTSSNTAYLQLSSLTSEDTAVY YCTASRTTALDYWGPGTTLTVSS |
| 169 | NV-01 VL | DIELTQPPSVSVSPGQTASITCSGDSLGSYYVHWYQQKPGQAPVLVIY RNKQRPSGIPERFSGSNSGNTATLTISGTQAEDEADYYCQTYDWMYS SRVFGGGTKLTVL |
| 170 | NV-01 VH | EVQLVESGGGLVKPGGSLRLSCAASGFTFSDYGIHWVRQAPGKGLEW VGRIKSKTDGGITEYAAPVKGRFTISRDDSKNTLYLQMNSLKTEDTAV YYCARAIYYLEAFDVWGQGTLVTVSS |

TABLE 2C

Binding data for E3 ligase binders

| Clone ID | Specificity | Octet KD (M) | Octet KD (M) |
|---|---|---|---|
| 020S-E06 | RNF43 | Not Tested | Not Tested |
| 020S-F06 | RNF43 | Not Tested | Not Tested |
| 028S-B01 | RNF43 | Not Tested | Not Tested |
| 028S-E01 | RNF43 | NB | NB |
| 028S-G01 | RNF43 | Not Tested | Not Tested |
| 028S-H01 | RNF43 | NB | NB |
| 028S-B02 | RNF43 | NB | NB |
| 028S-C02 | RNF43 | NB | NB |
| 024S-A02 | RNF43, ZRNF3 | 1.01E−05 | * |
| 028S-D02 | ZRNF3 | 3.32E−06 | * |
| 020S-H06 | ZRNF3 | NB | NB |
| 020S-A07 | ZRNF3 | NB | NB |
| 020S-B07 | ZRNF3 | NB | NB |
| 020S-D07 | RNF43, ZRNF3 | NB | NB |
| 020S-E07 | ZRNF3 | NB | NB |
| 020S-F07 | RNF43, ZRNF3 | NB | NB |
| 028S-H02 | ZRNF3 | 2.63E−06 | * |
| 028S-C03 | ZRNF3 | 2.51E−08 | *** |
| 028S-A04 | ZRNF3 | 3.62E−08 | *** |
| 028S-B04 | ZRNF3 | 2.56E−07 | ** |
| 028S-C04 | ZRNF3 | 1.64E−07 | ** |
| 028S-D04 | ZRNF3 | 8.74E−07 | ** |
| 028S-E04 | ZRNF3 | 9.53E−08 | *** |
| 028S-H04 | ZRNF3 | 4.80E−08 | *** |
| 028S-B06 | ZRNF3 | 7.64E−07 | ** |
| 028S-G06 | ZRNF3 | 1.09E−07 | ** |
| 028S-B07 | ZRNF3 | 6.54E−08 | *** |
| 028S-H07 | ZRNF3 | NB | NB |
| 028S-D08 | ZRNF3 | 1.39E−06 | * |
| 028S-E08 | ZRNF3 | 3.90E−06 | * |
| 028S-F08 | ZRNF3 | 1.04E−06 | * |
| 028S-A09 | ZRNF3 | 1.25E−05 | * |
| 028S-D09 | ZRNF3 | 3.54E−07 | ** |
| 028S-E10 | ZRNF3 | 4.16E−06 | * |
| 028S-G10 | ZRNF3 | 6.84E−07 | ** |
| 028S-A11 | ZRNF3 | 2.03E−07 | ** |
| SC-01 | RNF43 | Not Tested | Not Tested |
| SC-02 | RNF43 | Not Tested | Not Tested |
| NV-01 | ZRNF3 | Not Tested | Not Tested |

* Indicates KD ≥ 1 uM,
** Indicates 1 uM > KD ≥ 100 nM,
*** Indiciates 100 nM > KD,
NB indicates Non Binding
Binding specificity was determined by ELISA Targeting Modules Specific cell types and cells within specific tissue may comprise one or more cell- or tissue-specific surface molecule, such as a cell surface receptor. As used herein, the molecule is said to be cell- or tissue-specific if a greater amount of the molecule is present on the specific cell or tissue type as compared to one or more other cell or tissue types, or any other cell or tissue type. In certain embodiments, the greater amount is at least two-fold, at least five-fold, at least 10-fold, at least 20-fold, at least 50-fold, or at least 100-fold as compared to the amount in the one or more other cell or tissue types, or any other cell or tissue type. In particular embodiments, the cell-specific surface molecule has increased or enhanced expression on a target organ, tissue or cell type, e.g., an organ, tissue or cell type in which it is desirous to enhance Wnt signaling, e.g., to treat or prevent a disease or disorder, e.g., as compared to one or more other non-targeted organs, tissues or cell types. In certain embodiments, the cell-specific surface molecule is preferentially expressed on the surface of the target organ, tissue or cell type as compared to one or more other organ, tissue or cell types, respectively. For example, in particular embodiments, a cell surface receptor is considered to be a tissue-specific or cell-specific cell surface molecule if it is expressed at levels at least two-fold, at least five-fold, fold, at least 10-fold, at least 20-fold, at least 30-fold, at least 40-fold, at least 50-fold, at least 100-fold, at least 500-fold, or at least 1000-fold higher in the target organ, tissue or cell than it is expressed in one or more, five or more, all other organs, tissues or cells, or an average of all other organs, tissue or cells, respectively. In certain embodiments, the tissue-specific or cell-specific cell surface molecule is a cell surface receptor, e.g., a polypeptide receptor comprising a region located within the cell surface membrane and an extracellular region to which the targeting module can bind. In various embodiments, the methods described herein may be practiced by specifically targeting cell surface molecules that are only expressed on the target tissue or a subset of tissues including the target tissue, or by specifically targeting cell surface molecules that have higher levels of expression on the target tissue as compared to all, most, or a substantial number of other tissues, e.g., higher expression on the target tissue than on at least two, at least five, at least ten, or at least twenty other tissues.

In particular embodiments, the targeting module binds to a tissue-specific surface molecule expressed on a target cell or tissue type of interest, i.e., a cell or tissue type wherein it is desired to enhance or increase Wnt signaling activity. The targeting modules that bind to each tissue-specific surface molecules can be, but are not limited to, antibodies or antigen-binding fragments thereof, peptides, natural ligands of tissue- or cell-specific receptors, or their derivatives, and synthetic small molecules, etc.

The targeted tissue bound by the targeting module may be any tissue, e.g., any mammalian tissue or cell type. In certain embodiments, the targeted tissue may be present in any organ. In certain embodiments, the target tissue is bone tissue, liver tissue, skin tissue, stomach tissue, intestine tissue, oral mucosa tissue, kidney tissue, central nervous system tissue, mammary gland tissue, taste bud tissue, ovary tissue, inner ear tissue (including cochlear and vestibular tissues), hair follicles, pancreas tissue, retina tissue, cornea tissue, heart tissue or lung tissue, and the targeting module binds to a tissue-specific cell surface molecule (e.g., a cell surface receptor) preferentially expressed on bone tissue, liver tissue, skin tissue, stomach tissue, intestine tissue, oral mucosa tissue, kidney tissue, central nervous system tissue, mammary gland tissue, taste bud tissue, ovary tissue, inner ear tissue (including cochlear and vestibular tissues), hair follicles, pancreas tissue, retina tissue, cornea tissue, heart tissue or lung tissue, respectively.

The targeting module may bind to any cell type, e.g., any cell within any tissue, organ or animal, including but not limited to mammals, such as humans. In certain embodiments, the tissue-specific Wnt signal enhancing molecule binds to specific cell types, e.g., specific cell types associated with a target tissue. For example, in liver tissue, the targeting module may bind to hepatocytes, precursors and stem cells of hepatocytes, biliary tract cells, and/or endothelial or other vascular cells. For example, in bone tissue, the targeting module may bind osteoblasts, precursors of osteoblasts, mesenchymal stem cells, stem cells and precursor cells that give rise to bone, cartilage and/or other cells present in bone tissue. Cell types present in various tissues, including but not limited to the tissues described herein, are known in the art, and in various embodiments, the tissue-specific Wnt signal enhancing molecules described herein may bind any of them. In certain embodiments, the targeting module binds to liver tissue or liver cells.

The asialoglycoprotein receptor (ASGPR) is comprised of ASGR1 and ASGR2 (reviewed, for example by Stockert, Morell and Ashwell, 1991, Targeted Diagnostics and Therapy 4: 41-64). This receptor is a transmembrane protein that plays a critical role in serum glycoprotein homeostasis by mediating the endocytosis and lysosomal degradation of glycoproteins with exposed terminal galactose or N-acetyl-galactosamine residues. Thus, natural and synthetic ligands of AGPR include, but are not limited to, galactosylated cholinesterase, galactose (Gal) and N-acetylgalactosamine (GalNAc), GalNAc containing molecules such as GalNAc-terminating glycoproteins, and mono-, oligo-, or poly-saccharide containing molecules or nano-particles (reviewed, for example, by D' Souza and Devaraj an 2015, Journal of Controlled Release, 203:126-139.

The SLC10 family transport bile acids, sulphated solutes, and other xenobiotics in a sodium-dependent manner. The founding members, SLC10A1 (NTCP) and SLC10A2 (ASBT) function to maintain the enterohepatic circulation of bile acids. Examples of natural and synthetic ligands of SLC10A include, but are not limited to, cholate, Na(+)/bile acid, Na(+)/taurocholate, and the preS1 domain of hepatitis B virus and the fragments or variants thereof (reported, for example, by Yan et al., 2012 eLife, 1:e00049).

Transferrin receptor 2 (TFR2) is a homologue of transferrin receptor 1 (TFR1), the protein that delivers iron to cells through receptor-mediated endocytosis of diferric transferrin (Fe2TF). TFR2 also binds Fe2TF, but it seems to function primarily in the regulation of systemic iron homeostasis (reviewed, for example, by Worthen and Enns, 2014, Frontiers in Pharmacology 5:34). Examples of natural and synthetic ligands and binding partners of TFR2 include, but are not limited to, transferrin, such as diferric transferrin, and the hemochromatosis (HFE) protein and fragments and variants thereof.

The type 1 receptor (PTH1R) for parathyroid hormone (PTH) and PTH-related peptide (PTHrP) is highly expressed in bone and kidney (reviewed, for example, by Mannstadt, Juppner, and Gardella, 1999, American Journal of Physiology 277: F665-F675). Natural and synthetic ligands of parathyroid hormone receptor 1 (PTH1R) include, but are not limited to, PTH, PTHrP, and fragments and variants thereof.

Ly6/PLAUR domain-containing protein 3 (LYPD3) is a GPI-anchored protein exhibiting highly specific expression in stratified squamous epithelium found in tissues such as oral mucosa, skin and esophagus. LYPD3 expression was also seen upregulated in migrating keratinocytes during wound healing as well as various cancers (reviewed, e.g., by Jacobsen, Kriegbaum, Santoni-Rugiu and Ploug, 2014, World Journal of Clinical Oncology, 5(4):621-32). Even though LYPD3 expression has been reported, its exact function remains unclear, since animals lacking LYPD3 gene are viable, fertile and no obvious defect in development of squamous epithelia. Various molecules have been identified as binding partners of LYPD3. Lamininl, laminin5, and galectin-3 associate with LYPD3 to promote cell migration (Paret, Bourouba, Beer, Miyazaki, Schnölzer, Fiedler and Zöller. International Journal of Cancer. 2005 Jul. 10; 115(5):724-33). Anterior gradient 2, AGR2, interacts with LYPD3 and promotes cancer growth, metastasis and resistance to therapy in pancreatic ductal adenocarcinoma (PDAC) (Arumugam, Deng, Bover, Wang, Logsdon and Ramachandran. Molecular Cancer Therapeutics. 2015 April; 14(4):941-51). Under hypoxic condition, LYPD3 forms a complex with α6β4 integrin and matrix metalloproteinase 14 (MMP14), which promotes cancer cell motility through focalized laminin 332 degradation. (Ngora, Galli, Miyazaki and Zöller. Neoplasia. 2012 February; 14(2):95-107).

Desmoglein 3 (DSG3) encodes a calcium-binding transmembrane glycoprotein that is a member of cadherin cell adhesion molecule superfamily of proteins. DSG3 is expressed in desmosomes, special structure for cell to cell adhesion, in epithelium and mucosa. DSG3 has five extracellular cadherin domains (ECDs) containing Ca2+-binding sites that are required for DSG3 intercellular interaction (reviewed, e.g., by Thomason, Scothern, McHarg and Garrod, 2010, Biochemical Journal, 429 (3): 419-433). DSG3 intercellular interaction is mediated by trans-homophilic interaction near their N-termini. The loss of DSG3 in animals causes very severe erosion in oral mucosa and hair loss at weaning, indicating how important this gene is for the integrity of epithelial cells in these tissues. Single molecule atomic force microscopy experiment has shown a homophilic trans DSG3-binding via extracellular cadherin domains (Heupel, Zillikens, Drenckhahn and Waschke. Journal of Immunology. Aug. 1, 2008, 181 (3) 1825-1834).

In various embodiments, the tissue-specific surface molecules are tissue-specific cell surface receptors. For liver, these include, but are not limited to, ASGR1, ASGR2, TFR2, SLC10A1, etc. In certain embodiments, the targeting module is a natural ligand, or functional variant or fragment thereof, or an antibody, or antigen-binding fragment thereof, that binds ASGR1, ASGR2, TFR2, SLC10A1, LYPD3, or DSG3. For bone or kidney, such tissue-specific cell surface receptors include, but are not limited to, parathyroid hormone receptor 1 (PTH1R), etc. In certain embodiments, the targeting module is a natural ligand, or a functional variant or fragment thereof, or an antibody, or antigen-binding fragment thereof, that binds PTH1R. For oral mucosa, such tissue-specific cell surface receptors include, but are not limited to, LYPD3 and DSG3. In certain embodiments, the targeting module is a natural ligand, or a functional variant or fragment thereof, or an antibody, or antigen-binding fragment thereof, that binds LYPD3 or DSG3.

In particular embodiments, the targeting module binds to human ASGR1 (hASGR1; NCBI reference sequence NP 001662.1, residues 62-291; SEQ ID NO:35-36), human ASGR2 (hASGR2; NCBI reference sequence NP 550436.1, residues 66-292; SEQ ID NO:37-38), cynomolgus ASGR1 (cynoASGR1, sequence ID XP 005582755.1, residues 62-291; SEQ ID NO:39-40), or.cynomolgus ASGR2 (cynoASGR2; SEQ ID NO:41-42). In certain embodiments, the targeting module comprises an antibody or antigen-binding fragment thereof, comprising the CDRH1, CDRH2 and CDRH3 sequences set forth for any of the antibodies listed in Table 3A; and/or CDRL1, CDRL2 and CDRL3 sequences set forth for any of the antibodies of Table 3A, or a variant of said antibody, or antigen-binding fragment thereof, comprising one or more amino acid modifications, wherein said variant comprises less than 8 amino acid substitutions in said CDR sequences. In particular embodiments, the isolated antibody, or antigen-binding fragment thereof comprises a heavy chain variable region, light chain, nanobody, or scFv sequence comprising an amino acid sequence having at least 90% identity to the heavy chain variable region, light chain, nanobody or scFv of any of these antibodies, e.g., any of SEQ ID NOs: 47-77, 151-154, 171-179, 180-185 or 274-305 (see, e.g. Table 3B or 3C).

TABLE 3A

| Clone IDs and CDR sequences of binders against hASGR1/2 | | | | | | | |
|---|---|---|---|---|---|---|---|
| Clone ID | Specificity | CDRH1 | SID NO. | CDRH2 | SID NO. | CDRH3 | SID NO. |
| 024S-D03 | ASGR1 | DSVSSNSAAWN | 505 | GRTYYRSKWYNDYA | 551 | CARWNHEEHYFDYW | 589 |
| 024S-E03 | ASGR1 | ASVSSNSAAWN | 504 | GRTYYRSKWYNDYA | 551 | CARWNHEEHYFDYW | 589 |
| 024S-A04 | ASGR1 | DSVSSNSVAWN | 505 | GRTYYRSKWYYDYA | 552 | CASWTRGAFDIW | 594 |
| 020S-A05 | ASGR2 | GTFSSYAIS | 517 | GGIIPIFGTANYA | 544 | CAVSDGYDLDYW | 596 |
| 020S-C05 | ASGR2 | GTFSSYAIS | 517 | GGIIPIFGTANYA | 544 | CASFGVGAPDYW | 591 |
| 020S-G06 | ASGR2 | YTFTSYGIS | 533 | GWISAYNGNTNYA | 561 | CASAGGGYW | 590 |
| 020S-A06 | ASGR2 | YTFTGYHMH | 530 | GGIIPVFGAPNYA | 546 | CARDGGYGMDVW | 576 |
| 020S-B06 | ASGR2 | YTFTGYYMH | 531 | GIINPSGGGTSYA | 548 | CARDTGATAEYFQHW | 580 |
| 020S-C06 | ASGR2 | YSFTGNYMH | 520 | GGIIPMFGTVKYA | 545 | CAKDRGYRFDFDLW | 570 |
| 020S-D06 | ASGR2 | FTFSSYAMS | 508 | SYISSYNSHTNDA | 568 | CARWAVAAGGQYYYMDVW | 588 |
| 020S-C07 | ASGR2 | YTFSNYYMH | 525 | GWINPKSGGTKYA | 559 | CARDRGITMVRGVMDYW | 579 |

TABLE 3A-continued

Clone IDs and CDR sequences of binders against hASGR1/2

| Clone | Target | CDR1 | # | CDR2 | # | CDR3 | # |
|---|---|---|---|---|---|---|---|
| 028S-H09 | ASGR2 | YTFTTYYMH | 535 | GWINPNGGGTNYA | 560 | CAKDRTAMAPEGAFDIW | 571 |
| 028S-C11 | ASGR2 | YTFSDYYVH | 524 | GIINPRNGRTSYA | 547 | CARDHLYGMDVVV | 577 |
| 028S-D11 | ASGR2 | FTVSSNYMS | 514 | SAISGSGGSTYYA | 565 | CAKDSPIVRRGERGRYYGMDVVV | 572 |
| 028S-G11 | ASGR2 | YTFTDYNMH | 527 | GWMNPNTGNTAYA | 562 | CARDKNYYGMDVVV | 578 |
| 020S-H05 | ASGR2 | HTFSSYAMG | 518 | AAISQSGYVRYYA | 536 | CNARWGAGSLFASW | 599 |
| Abv-3D11 | ASGR2 | GFSFNTY | 515 | RSKSNNYA | 564 | PRYDYWYFDV | 605 |
| Abv-10B8 | ASGR2 | GFTFSSY | 516 | SSGGDY | 567 | EGTGGMDY | 604 |
| RO-01 | ASGR1 | GFTFSSY | 516 | SGSGGS | 566 | DFSSRRWYLEY | 603 |
| RO-02 | ASGR1 | FTFSSYAMS | 509 | AISGSGGSTYYA | 538 | CAKSWYLPGRGFDYW | 575 |
| RO-03 | ASGR1 | FTFSSYAMS | 509 | AISGSGGSTYYA | 538 | CAKSSFTFGRYFDYW | 574 |
| RO-04 | ASGR1 | FTFSSYAMS | 509 | AISGSGGSTYYA | 538 | CAKSSFSYLRAFDYW | 573 |
| LP1-1F8 | ASGR1 | FTFSTYTMS | 511 | ATISSIGVNTYYP | 541 | CARHVDYYDGISFDYW | 583 |
| LP1-1N15 | ASGR1 | YTFTDYYMN | 529 | GRVIPSNGGTNYN | 554 | CARGMDYW | 582 |
| LP1-1P13 | ASGR1 | YSFTDYFMN | 519 | GRFNPFNGQTFYN | 550 | CARRGRYDVYYVLDYW | 586 |
| LP1-1P5 | ASGR1 | YTFLTYWMN | 523 | GQIFPATGITYYS | 549 | CARRAYHSNFFDYW | 587 |
| LP1-2E12 | ASGR1 | YSITSGYYWN | 522 | GSIGYDDTNHYN | 557 | CAGDYPFAFW | 569 |
| LP1-2I13 | ASGR1 | FTFSDYGMH | 507 | AYISSGSSTIYYA | 542 | CSRKGGFGDYEKSYAMDYW | 600 |
| LP1-2I22 | ASGR1 | YSFTGYFMN | 521 | GRFNPFNGQTFYN | 550 | CARRGRYDVYYALDYW | 585 |
| LP1-3A24 | ASGR1 | YTFTDYYIN | 528 | GRVIPSNGGSNYN | 553 | CATQLGRW | 595 |
| LP1-3E20 | ASGR1 | YTFTSYWIH | 534 | GYINPSSGYAEYN | 563 | CARESYYSFDYTMDYW | 581 |
| LP1-6H3 | ASGR1 | YTFSRFDMH | 526 | GVIYPGNGDTSYN | 558 | CASSYYGNPW | 593 |
| LP1-7B13 | ASGR1 | FTFTDYYMN | 512 | GRVNPSNDDTRYN | 556 | CTRWFYFDYW | 601 |
| LP1-7I20 | ASGR1 | FTFTDYYMS | 513 | ALIRNKANGYTTEYS | 539 | CAVTYGAYW | 597 |
| LP1-8M24 | ASGR1 | YTFTNYGIN | 532 | GEIFPRSDNTFYN | 543 | CARKGRDYGTSHYFDYW | 584 |
| LP1-9C3 | ASGR1 | FSLSTSYMGVS | 506 | AHIFWDDDKRYN | 537 | CGGPYYPFTYW | 598 |
| LP1-9M16 | ASGR1 | YTFTDYYMN | 529 | GRVNPNGGSNYN | 555 | CASRNFDVW | 592 |
| LP1-10C22 | ASGR1 | FTFSSYGMS | 510 | ASIS SGGSYTYYP | 540 | CVRHEEYGKSGFAYW | 602 |

TABLE 3A-continued

Clone IDs and CDR sequences of binders against hASGR1/2

| Clone ID | Specificity | CDRL1 | SID NO. | CDRL2 | SID NO. | CDRL3 | SID NO. |
|---|---|---|---|---|---|---|---|
| 024S-D03 | ASGR1 | RASQSVGSYLA | 625 | DATNRAT | 644 | CQHRRTF | 679 |
| 024S-E03 | ASGR1 | RASQSVGSYLA | 625 | DATNRAT | 644 | CQHRRTF | 679 |
| 024S-A04 | ASGR1 | RASQSVGSYLA | 625 | DATNRAT | 644 | CQHRRTF | 679 |
| 020S-A05 | ASGR2 | RASQSVGSYLA | 625 | DASNRAT | 643 | CQQRSNWPLTF | 685 |
| 020S-C05 | ASGR2 | RASQSVSSYLA | 626 | DASNRAT | 643 | CQQRSNWPVTF | 686 |
| 020S-G06 | ASGR2 | RSSQSLLHSDGHNYLQ | 630 | LGSYRAS | 651 | CMQATHWPPTF | 670 |
| 020S-A06 | ASGR2 | RASQNIYTYLN | 618 | AASSLQS | 638 | CQQYYNYPITF | 692 |
| 020S-B06 | ASGR2 | RASQGISSWLA | 617 | AASSLQS | 638 | CQQAYDFPLTF | 682 |
| 020S-C06 | ASGR2 | RASQSISSWLA | 623 | AATTLQS | 640 | CQQSYSTPLTF | 688 |
| 020S-D06 | ASGR2 | RASQGIATWLA | 616 | DASNLQS | 641 | CQQANSFPVTF | 681 |
| 020S-C07 | ASGR2 | RASQSISRYLN | 622 | DASNLRS | 642 | CQQGYTIPITF | 684 |
| 028S-H09 | ASGR2 | RASQSISSYLN | 624 | QASNKDT | 655 | CQQGYSTPLTF | 683 |
| 028S-C11 | ASGR2 | RASQSINNYLN | 619 | AASSLQS | 638 | CQQANSFPLTF | 680 |
| 028S-D11 | ASGR2 | RSSQSLLHSNGYNYLD | 631 | AASNLQS | 636 | CMQALQTPLTF | 669 |
| 028S-G11 | ASGR2 | RASQSISNWLA | 620 | AASRLQS | 637 | CQQTYAIPLTF | 689 |
| 020S-H05 | ASGR2 | | | | | | |
| Abv-3D11 | ASGR2 | KSSQSLLDSDGKTYLN | 611 | LVSKLDS | 652 | WQGTHFPYT | 696 |
| Abv-10B8 | ASGR2 | SASSSVSSSFLH | 634 | RTSNLAS | 658 | QQWSGYPYT | 695 |
| RO-01 | ASGR1 | QGDSLRSYYAS | 613 | GKNNRPS | 648 | NSLERIGYLSYV | 694 |
| RO-02 | ASGR1 | QGDSLRSYYAS | 613 | GKNNRPS | 648 | CNSRLRSGKMVVF | 673 |
| RO-03 | ASGR1 | QGDSLRSYYAS | 613 | GKNNRPS | 648 | CNSRKSSSKNVVF | 672 |
| RO-04 | ASGR1 | QGDSLRSYYAS | 613 | GRNNRPS | 649 | CNSRDRRGYSVF | 671 |
| LP1-1F8 | ASGR1 | KSSQSLFNSRTRKNYLA | 610 | WASTRES | 661 | CKQSYYLLTF | 663 |
| LP1-1N15 | ASGR1 | KASQDINSHLS | 606 | RANRLVD | 657 | CLQYDEFPFTF | 667 |
| LP1-1P13 | ASGR1 | RTSENIYSNLA | 632 | AATNLAD | 639 | CQHFWGSTWTF | 674 |
| LP1-1P5 | ASGR1 | KASQNVGTNVA | 609 | SASYRYS | 659 | CQQYNSYPLTF | 691 |
| LP1-2E12 | ASGR1 | RSSQSLANSYGNTYLS | 629 | GISNRFS | 647 | CLQGTHQPLTF | 665 |
| LP1-2I13 | ASGR1 | RASENIYSYLV | 615 | NAKTLAE | 653 | CQHHYGTWTF | 678 |
| LP1-2I22 | ASGR1 | RASENIYSNLA | 614 | GATNLAD | 646 | CQHFWGTTWTF | 676 |
| LP1-3A24 | ASGR1 | KASQNVGSNVA | 608 | SSSYRYS | 660 | CQQYNSFPLTF | 690 |
| LP1-3E20 | ASGR1 | KASQDINSYLS | 607 | RANRLVD | 657 | CLQYDDLWTF | 666 |
| LP1-6H3 | ASGR1 | KSSQSLLDSDGKTYLN | 612 | LVSKLDS | 652 | CWQGTHFPHTF | 693 |
| LP1-7B13 | ASGR1 | RASQSISNYLH | 621 | FASQSIS | 645 | CQQSNSWPLTF | 687 |

TABLE 3A-continued

Clone IDs and CDR sequences of binders against hASGR1/2

| | | | | | | | |
|---|---|---|---|---|---|---|---|
| LP1-7I20 | ASGR1 | RTSENIYSYLA | 633 | NAKTLAK | 654 | CQHHYGTPYTF | 677 |
| LP1-8M24 | ASGR1 | RISENIYSNLA | 627 | AAINLAD | 635 | CQHFWGTPFTF | 675 |
| LP1-9C3 | ASGR1 | RSSQSLANSYGNTYLS | 629 | GISNRFS | 647 | CLQATHQPWTF | 664 |
| LP1-9M16 | ASGR1 | KASQDINSYLS | 607 | RANRLAD | 656 | CLQYDEFPLTF | 668 |
| LP1-10C22 | ASGR1 | RSSQGIVHSNGNIYLE | 628 | KVSNRFS | 650 | CFQGSHVPPTF | 662 |

TABLE 3B

Description of Sequence Identifiers (ASGR targeting modules)

| SID NO: | Brief Description | Sequence |
|---|---|---|
| 47 | 024S-D03 VL | EIVLTQSPATLSFSPGERATLSCRASQSVGSYLAWYQQRPGQAPRPLIYDATNRATGIPTRFSGSGSGTDFTLTISSLEPEDFATYYCQHRRTFGRGTKLEIK |
| 48 | 024S-D03 VH | QVQLQQSGPGLVKPSQTLSLTCAISGDSVSSNSAAWNWMRQSPSRGLEWLGRTYYRSKWYNDYAVSVKSRMTINPDTSRNQFSLQLNSVTLEDTAVYYCARWNHEEHYFDYWGQGTLVTVSS |
| 49 | 024S-E03 VL | DVVMTQSPATLSFSPGERATLSCRASQSVGSYLAWYQQRPGQAPRPLIYDATNRATGIPTRFSGSGSGTDFTLTISSLEPEDFATYYCQHRRTFGRGTKLEIK |
| 50 | 024S-E03 VH | QVQLQQSGPGLVKPSQTLSLTCAISGASVSSNSAAWNWIRQSPSRGLEWLGRTYYRSKWYNDYAVSVKSRITINPDTSKNQFSLQLNSVTPGDTAVYYCARWNHEEHYFDYWGQGTLVTVSS |
| 51 | 024S-A04 VL | DIQLTQSPATLSFSPGERATLSCRASQSVGSYLAWYQQRPGQAPRPLIYDATNRATGIPTRFSGSGSGTDFTLTISSLEPEDFATYYCQHRRTFGRGTKLEIK |
| 52 | 024S-A04 VH | QVQLQQSGPGLVKPSQTLSLTCAISGDSVSSNSVAWNWMRQSPSRGLEWLGRTYYRSKWYYDYAVSVKSRITINPDTSKNQFSLQLNSVTPEDTAVYYCASWTRGAFDIWGQGTMVTVSS |
| 53 | 020S-A05 VL | EIVMTQSPATLSLSPGERATLSCRASQSVGSYLAWYQQKPGLAPRLLIYDASNRATGIPARFSGSGSGTDFTLTISSLEPEDFAVYYCQQRSNWPLTFGGGTKVEIK |
| 54 | 020S-A05 VH | EVQLVESGAEVKKPGSSVKVSCKASGGTFSSYAISWVRQAPGQGLEWMGGIIPIFGTANYAQKFQGRVTITADESTSTAYMELSSLRSEDTAVYYCAVSDGYDLDYWGQGTLVTVSS |
| 55 | 020S-C05 VL | EIVLTQSPATLSLSPGERATLSCRASQSVSSYLAWYQQKPGQAPRLLIHDASNRATGIPARFSGSGSGTDFTLIISSLEPEDFAVYYCQQRSNWPVTFGGGTKVEIK |
| 56 | 020S-C05 VH | EVQLVQSGAEVKKPGSSVKVSCKASGGTFSSYAISWVRQAPGQGLEWMGGIIPIFGTANYAQKFQGRVTITADESTSTAYMELSSLRSEDTAVYYCASFGVGAPDYWGQGTLVTVSS |
| 57 | 020S-G06 VL | DVVMTQSPLSLPVTPGEPASISCRSSQSLLHSDGHNYLQWYLQKPGQSPQLLILLGSYRASGVPDRFSGSGSGTDFTLKISRVEAEDVGVYYCMQATHWPPTFGQGTKVEIK |
| 58 | 020S-G06 VH | EVQLVQSGAEVKKPGATVKVSCKASGYTFTSYGISWVRQAPGQGLEWMGWISAYNGNTNYAQKLQGRVTMTTDTSTAYMELRSLRSDDTAVYYCASAGGGYWGQGTLVTVSS |
| 59 | 020S-A06 VL | DIQMTQSPSSLSASVGDRVTITCRASQNIYTYLNWYQQKPGKAPKLLIYAASSLQSGVPSRFSGSGSGTDFTLTISSLQPEDFATYYCQQYYNYPITFGQGTRLEIK |
| 60 | 020S-A06 VH | QVQLVQSGAEVKKPGSSVKVSCKASGYTFTGYHMHWVRQAPGQGLEWVGGIIPVFGAPNYAQKFQGRVTITADESTSTAYMELSSLRSEDTAVYYCARDGGYGMDVWGQGTMVTVSS |

TABLE 3B-continued

Description of Sequence Identifiers (ASGR targeting modules)

| SID NO: | Brief Description | Sequence |
|---|---|---|
| 61 | 020S-B06 VL | DIQMTQSPSSLSASVGDRVTITCRASQGISSWLAWYQQKPGKAPKLLIY AASSLQSGVPSRFSGSGSGTDFTLTISSLQPED FATYYCQQAYDFPLTFGGGTKVEIK |
| 62 | 020S-B06 VH | QVQLVQSGAEVKKPGASVKVSCKASGYTFTGYYMHWVRQAPGQGLE WMGIINPSGGGTSYAQKFQGRVTMTRDTSTSTV YMELSSLRSEDTAVYYCARDTGATAEYFQHWGQGTLVTVSS |
| 63 | 020S-C06 VL | DIQMTQSPSSLSASVGDRVTITCRASQSISSWLAWYQQKPGKAPKLLIY AATTLQSGVPSRFSGSGSGTDFTLTISSLQPEDFA TYYCQQSYSTPLTFGQGTKLEIK |
| 64 | 020S-C06 VH | QVQLVQSGAEVKKPGSSVKVSCKASGYSFTGNYMHWVRQAPGQGLE WMGGIIPMFGTVKYAQKFQGRVTITADESTSTAYM ELSSLRSEDTAVYYCAKDRGYRFDFDLWGRGTLVTVSS |
| 65 | 020S-D06 VL | DIQMTQSPSSLSASVGDRVTITCRASQGIATWLAWYQQKPGKAPKLLI YDASNLQSGVPSRFSGSGSGTDFTLTISSLQPEDFA TYYCQQANSFPVTFGPGTKVDIK |
| 66 | 020S-D06 VH | EVQLLESGGGLVQPGGSLRLSCAASGFTFSSYAMSWVRQAPGKGLEW VSYISSYNSHTNDADSVKGRFTISRDNSKNTLYLQ MNSLRAEDTAVYYCARWAVAAGGQYYYMDVWGKGTTVTVSS |
| 67 | 020S-C07 VL | DIQMTQSPSSLSASVGDRVTITCRASQSISRYLNWYQQKPGKAPKLLIY DASNLRSGVPSRFSGSGSGTDFTLTISSLQPEDFA TYYCQQGYTIPITFGQGTKVEIK |
| 68 | 020S-C07 VH | QVQLVQSGAEVKKTGASVKVSCKASGYTFSNYYMHWVRQAPGQGLE WMGWINPKSGGTKYAQKFQGRVTMTRDTSTSTVY MELSSLRSEDTAVYYCARDRGITMVRGVMDYWGQGTLVTVSS |
| 69 | 028S-H09 VL | DIQMTQSPSSLSASVGDRVTITCRASQSISSYLNWYQQKPGKAPKLLIY QASNKDTGVPSRFSGSGSGTDFTLTISSLQPEDFAT YYCQQGYSTPLTFGGGTKVEIK |
| 70 | 028S-H09 VH | QVQLVQSGAEVKKPGATVKVSCKASGYTFTTYYMEIWVRQAPGQGLE WMGWINPNGGGTNYAQKFQGRVTMTRDTSTSTVYM ELSSLRSEDTAVYYCAKDRTAMAPEGAFDIWGQGTMVTVSS |
| 71 | 028S-C11 VL | DIQMTQSPSSLSASVGDRVTITCRASQSINNYLNWYQQKPGKAPKLLIY AASSLQSGVPSRFSGSGSGTDFTLTISSLQPEDFATY YCQQANSFPLTFGGGTKVEIK |
| 72 | 028S-C11 VH | QVQLVQSGAEVKKPGASVKVSCKASGYTFSDYYVHWVRQAPGQGLE WMGIINPRNGRTSYAQRFQGRVTMTRDTSTSTVYME LSSLRSEDTAVYYCARDHLYGMDVWGQGTTVTVSS |
| 73 | 028S-D11 VL | DIVMTQSPLSLPVTPGEPASISCRSSQSLLHSNGYNYLDWYLQKPGQSP QLLIYAASNLQSGVPDRFSGSGSGTDFTLKISRVEAE DVGVYYCMQALQTPLTFGGGTKVEIK |
| 74 | 028S-D11 VH | EVQLLESGGGLVQPGGSLRLSCAASGFTVSSNYMSWVRQAPGKGLEW VSAISGSGGSTYYADSVKGRFTISRDNSKNTLYLQM NSLRAEDTAVYYCAKDSPIVRRGERGRYYGMDVWGQGTTVTVSS |
| 75 | 028S-G11 VL | DIQMTQSPSSLSASVGDRVTITCRASQSISNWLAWYQQKPGKAPKLLIY AASRLQSGVPSRFSGSGSGTDFTLTISSLQPEDFATY YCQQTYAIPLTFGGGTKVEIK |
| 76 | 028S-G11 VH | QVQLVQSGAEVKKPGASVKVSCKASGYTFTDYNMHWVRQAPGQGLE WMGWMNPNTGNTAYAQKFQGRVTMTRDTSTSTVYM ELSSLRSEDTAVYYCARDKNYYGMDVWGQGTTVTVSS |
| 77 | 020S-H05 nAb | EVQLVESGGGLVQAGDSLRLSCTASGHTFSSYAMGWFRQAPGKEREF VAAISQSGYVRYYADSVKGRFTISRDNAKNTVYLQMN SLKPDDTAVYYCNARWGAGSLFASWGQGTQVTVSS |
| 151 | Abv-3D11 VL | EVVMTQTPLTLSVTIGQPASISCKSSQSLLDSDGKTYLNWLLQRPGQSP KRLIYLVSKLDSGVPDRFTGSGSGTDFTLKISRVEAEDL GVYYCWQGTHFPYTFGGGTKLEIK |
| 152 | Abv-3D11 VH | EVQLVESGGGLVQPKGSLKLSCAASGFSFNTYAMNWVRQAPGKGLE WVARIRSKSNNYATYYADSVKDRFTISRDDSESMLYL QMNNLKTEDTAMYYCVRPRYDYWYFDVWGTGTTVTVSS |

TABLE 3B-continued

Description of Sequence Identifiers (ASGR targeting modules)

| SID NO: | Brief Description | Sequence |
|---|---|---|
| 153 | Abv-10B8 VL | ENVLTQSPAIMAASLGQKVTMTCSASSSVSSSFLHWYQQKSGASPKPLI HRTSNLASGVPARFSGSGSGTSYSLTISSVEAED DATYYCQQWSGYPYTFGGGTKLEIK |
| 154 | Abv-10B8 VH | DVKLVESGEGLVKPGGSLKLSCAASGFTFSSYAMSWVRQTPEKRLEW VAYISSGGDYIYYVDTVKGRFTISRDNARNTLYL QMSSLKSEDTAVYYCTREGTGGMDYWGQGTSVTVSS |
| 171 | RO-01v VL | DIELTQDPAVSVALGQTVRITCQGDSLRSYYASWYQQKPGQAPVLVIY GKNNRPSGIPDRFSGSSSGNTASLTITGAQAE DEADYYCNSLERIGYLSYVFGGGTKLTVL |
| 172 | RO-01 VL | SSELTQDPAVSVALGQTVRITCQGDSLRSYYASWYQQKPGQAPVLVIY GKNNRPSGIPDRFSGSSSGNTASLTITGAQAEDE ADYYCNSLERIGYLSYVFGGGTKLTVL |
| 173 | RO-01 VH | EVQLLESGGGLVQPGGSLRLSCAASGFTFSSYAMSWVRQAPGKGLEW VSAISGSGGSTYYADSVKGRFTISRDNSKNTLYL QMNSLRAEDTAVYYCAKDFSSRRWYLEYWGQGTLVTVSS |
| 174 | RO-02 VL | SSELTQDPAVSVALGQTVRITCQGDSLRSYYASWYQQKPGQAPVLVIY GKNNRPSGIPDRFSGSSSGNTASLTITGAQAE DEADYYCNSRLRSGKMVVFGGGTKLTVL |
| 175 | RO-02 VH | EVQLLESGGGLVQPGGSLRLSCAASGFTFSSYAMSWVRQAPGKGLEW VSAISGSGGSTYYADSVKGRFTISRDNSKN TLYLQMNSLRAEDTAVYYCAKSWYLPGRGFDYWGQGTLVTVSS |
| 176 | RO-03 VL | SSELTQDPAVSVALGQTVRITCQGDSLRSYYASWYQQKPGQAPVLVIY GKNNRPSGIPDRFSGSSSGNTASLTITGAQAE DEADYYCNSRKSSSKNVVFGGGTKLTVL |
| 177 | RO-03 VH | EVQLLESGGGLVQPGGSLRLSCAASGFTFSSYAMSWVRQAPGKGLEW VSAISGSGGSTYYADSVKGRFTISRDNSKNT LYLQMNSLRAEDTAVYYCAKSSFTFGRYFDYWGQGTLVTVSS |
| 178 | RO-04 VL | SSELTQDPAVSVALGQTVRITCQGDSLRSYYASWYQQKPGQAPVLVIY GRNNRPSGIPDRFSGSSSGNTASLTITGAQAE DEADYYCNSRDRRGYSVFGGGTKLTVL |
| 179 | RO-04 VH | EVQLLESGGGLVQPGGSLRLSCAASGFTFSSYAMSWVRQAPGKGLEW VSAISGSGGSTYYADSVKGRFTISRDNSKNTL YLQMNSLRAEDTAVYYCAKSSFSYLRAFDYWGQGTLVTVSS |
| 274 | LP1-1F8 VL | DIVMSQSPSSLAVSAGEKVTMSCKSSQSLFNSRTRKNYLAWYQQKPG QSPKLLIYWASTRESGVPDRFTGSGSGTDFTLTI SSVQAEDLAVYYCKQSYYLLTFGAGTKLELK |
| 275 | LP1-1F8 VH | EVKLVESGGGLVKPGGSLKLSCAASGFTFSTYTMSWVRQTPAKRLEW VATISSIGVNTYYPDSVKGRFTISRDNARNTLYL QVSSLRSEDTAMYYCARHVDYYDGISFDYWGQGTTLTVSS |
| 276 | LP1-1N15 VL | DIKMTQSPSSMYASLGERVTITCKASQDINSHLSWFQQKPGKSPKTLIIR ANRLVDGVPSRFSGSGSGQDYSLTISSPEYEEM GIYYCLQYDEFPFTFGGGTKLEIK |
| 277 | LP1-1N15 VH | EVQLQQSGPELVKPGASVKMSCKASGYTFTDYYMNWVKQSHGESLE WIGRVIPSNGGTNYNQKFKGKATLTVDKSLTTA YMQLNSLTSEDSAVYFCARGMDYWGPGTSVTVSS |
| 278 | LP1-1P13 VL | DIQMTQSPASLSASVGQTVIITCRTSENIYSNLAWYQQKQGKSPQLLVY AATNLADGVPSRFSGSGSGTQYYLKINSLQSED FGSYYCQHFWGSTWTFGGGTKLDIK |
| 279 | LP1-1P13 VH | EVQLQQSGPELVKPGASVKISCKASGYSFTDYFMNWVKQSHGKSLEW IGRFNPFNGQTFYNQEFKGKATLTVDKSSSTAH MELRSLTSEDSAVYYCARRGRYDVYYVLDYWGQGTSVTVSS |
| 280 | LP1-1P5 VL | DIVMTQSQKFMSTSVGDRVSVTCKASQNVGTNVAWYQQKPGQSPKA LIYSASYRYSGVPDRFTGSGSGTDFTLTISNVQSE DLAEYFCQQYNSYPLTFGAGTKLELK |

TABLE 3B-continued

Description of Sequence Identifiers (ASGR targeting modules)

| SID NO: | Brief Description | Sequence |
|---|---|---|
| 281 | LP1-1P5 VH | QVQLQQSGPELVRPGTSVKISCKASGYTFLTYWMNWVKQRPGQGLE WIGQIFPATGITYYSEMFKDKATLTEDTSSTTAY MQLSSLTSEATAVYFCARRRAYHSNFFDYWGQGTTLTVSS |
| 282 | LP1-2E12 VL | DVVVTQTPLSLPVSFGDRVSISCRSSQSLANSYGNTYLSWYLHKPGQSP QLLIYGISNRFSGVPDRFSGSGSGTDFTLKISTIKP EDLGMYYCLQGTHQPLTFGAGTKLELK |
| 283 | LP1-2E12 VH | DVQLQESGPGLVKPSQSLSLTCSVTGYSITSGYYWNWIRQFPGNKLEW MGSIGYDDTNHYNPSLKNRISITRDTSKNQFFLK LNSVTTEDTATYYCAGDYPFAFWGQGTLVTVSA |
| 284 | LP1-2I13 VL | DIQMTQSPASLSASVGETVTITCRASENIYSYLVWYQQKQGKSPQLLV YNAKTLAEGVPSRFSGSGSGTQFSLKINSLQPED FGSYYCQHHYGTWTFGGGIKLEIK |
| 285 | LP1-2I13 VH | EVQLVESGGGLVKPGGSRKLSCAASGFTFSDYGMHWVRQAPEKGLE WVAYISSGSSTIYYADTVKGRFTISRDNAKNTL FLQMTSLRSEDTAMYYCSRKGGFGDYEKSYAMDYWGQGTSVTVSS |
| 286 | LP1-2I22 VL | DIQMTQSPASLSASVGETVIITCRASENIYSNLAWYQQKQGKSPQLLVY GATNLADGVTSRFSGSGSGTQFSLKIDSLQSE DFGSYYCQHFWGTTWTFGGGTKLEIK |
| 287 | LP1-2I22 VH | EVQLQQSGPELVKPGASVKISCKASGYSFTGYFMNWVKQSHGKSLEW IGRFNPFNGQTFYNQEFKGKATLTVDKSSDTAH MELRSLTSEDSAVYYCARRGRYDVYYALDYWGQGTSVTVSS |
| 288 | LP1-3A24 VL | DIVMTQSQKFMSTSVGDRVSVTCKASQNVGSNVAWFQQKPGQSPKAL IYSSSYRYSGVPDRFTGSGSGTDFTLTITNVQSE DLAEYFCQQYNSFPLTFGAGTKLELK |
| 289 | LP1-3A24 VH | EVQLQQSGPELVKPGASVKMSCKASGYTFTDYYINWVRQSHGKSLEW IGRVIPSNGGSNYNQKFKGKATLTVDKSLSTAY MHLNSLTSEDSAVYYCATQLGRWGQGTLVTVSA |
| 290 | LP1-3E20 VL | DIKMTQSPSSMYASLGERVTITCKASQDINSYLSWFQQKPGKSPKTLIY RANRLVDGVPSRFSGSGSGQDYSLTISSLEYEDM GIYYCLQYDDLWTFGGGTKLEIK |
| 291 | LP1-3E20 VH | QVQLQQSGAELAKPGASVKMSCKASGYTFTSYWIHWVKQRPGQGLE WIGYINPSSGYAEYNQKFKVRATLTADKSSSTAY MQLSSLTSEDSAVYYCARESYYSFDYTMDYWGQGTSVTVSS |
| 292 | LP1-6H3 VL | DVVMTQTPLTLSVTIGQPASISCKSSQSLLDSDGKTYLNWLLQRPGQSP KRLIYLVSKLDSGVPDRFTGSGSGTDFTLKISRV EAEDLGVYYCWQGTHFPHTFGSGTKLEIK |
| 293 | LP1-6H3 VH | QAYLQQSGAELVRPGASVKMSCKASGYTFSRFDMHWVKQTPRQGLE WIGVIYPGNGDTSYNQKFRDKASLTVDKSSSTAY MQLSSLTSEDSAVYFCASSYYGNPWGQGTTLTVSS |
| 294 | LP1-7B13 VL | DIVLTQSPATLSVTPGDRVSLSCRASQSISNYLHWYQQKSHESPRLLIKF ASQSISGIPSRFSGSGSGTDFTLTINSVETEDFG MYFCQQSNSWPLTFGAGTKLELK |
| 295 | LP1-7B13 VH | EVQLQQSGPEVVKPGASVKMSCKTSGFTFTDYYMNWVKQGHGKSLE WIGRVNPSNDDTRYNQKFKGKATLTVDKSLST AYMQLNSLTSEDSAVYYCTRWFYFDYWGQGTTLTVSS |
| 296 | LP1-7I20 VL | DIQMTQSPASLSASVGETVTITCRTSENIYSYLAWYQQKQGKSPQLLV YNAKTLAKGVPSRFSGSGSGTQFSLKINGLQPED FGNYYCQHHYGTPYTFGGGTKVEIK |
| 297 | LP1-7I20 VH | EVKLVESGGGLVQPGGSLSLSCAASGFTFTDYYMSWVRQPPGKALEW LALIRNKANGYTTEYSASVKGRFTISRDNSQSIL YLQMNALRAEDSATYYCAVTYGAYWGQGTLVTVSA |
| 298 | LP1-8M24 VL | DIQMTQSPASLSVSVGETVTITCRISENIYSNLAWYQQKQGKSPHLLVY AAINLADGVPSRFSGSGSGTQF SLKINSLQSEDFGSYYCQHFWGTPFTFGSGTKLEIK |
| 299 | LP1-8M24 VH | QVQLQQSGAELARPGASVKLSCKASGYTFTNYGINWVKQRTGQGLE WIGEIFPRSDNTFYNEKFKGKATLTADKS STTAYMELRSLTSEDSAVYFCARKGRDYGTSHYFDYWGQGTTLTVSS |

TABLE 3B-continued

Description of Sequence Identifiers (ASGR targeting modules)

| SID NO: | Brief Description | Sequence |
|---|---|---|
| 300 | LP1-9C3 VL | DVVVTQTPLSLPVSFGDQVSISCRSSQSLANSYGNTYLSWYLHKPGQSP QLLIYGISNRFSGVPDRFSGSGSGTDFTL KISTIKPEDLGIYYCLQATHQPWTFGGGTKLEIK |
| 301 | LP1-9C3 VH | QVTLKESGPGILQPSQTLSLTCSFSGFSLSTSYMGVSWIRKPSGKGLEW LAHIFWDDDKRYNPSLKSRLTISKDTSSN QVFLMITSVETADTATYYCGGPYYPFTYWGQGTLVTVSA |
| 302 | LP1-9M16 VL | DIKMTQSPSSMYASLGERVTITCKASQDINSYLSWFQQKPGKSPKTLIY RANRLADGVPSRFSGSGSGQDYSLTISNL EYEDMGIYYCLQYDEFPLTFGAGTKLELK |
| 303 | LP1-9M16 VH | EVQLQQSGPELVKPGASVKMSCKASGYTFTDYYMNWVKQSHGKSLE WIGRVNPNNGGSNYNQKFKGKATLTVDK SLSTAYMQLNSLTSEDSAVYYCASRNFDVWGAGTTVTVSS |
| 304 | LP1-10C22 VL | DVLMTQTPLSLPVSLGDQASISCRSSQGIVHSNGNIYLEWYLQKPGQSP KLLIYKVSNRFSGVPDRFSGSGSGTDFTLK ISRVEAEDLGVYYCFQGSHVPPTFGGGTKLEIK |
| 305 | LP1-10C22 VH | EVQLVESGGDLVKPGGSLKLSCAASGFTFSSYGMSWVRQTPDKRLEW VASISSGGSYTYYPDSVKGRFTISRDNAQN TLYLQMSSLKSEDTAMYYCVRHEEYGKSGFAYWGQGTLITVSA |

TABLE 3C

Description of Sequence Identifiers (Alternative targeting modules)

| SID NO: | Brief Description | Sequence |
|---|---|---|
| 180 | GT-01 (TFR1) VH | QVQLQQSGPELVRPGVSVKISCKGSGYTFTDYAMHWVKQSHAKS LEWIGGISTYFGRTNYNQKFKGKRATMTVDKSSSTAYMELARLTSE DSALYYCARGLSGNYVMDYWGQGTSVTVSS |
| 181 | GT-01 (TFR1) VL | DIVLFQSPASLAVSLGQRATISCRASESVDDYGNSFMHWYQQKPG QPPKLLIYRASNLESGIPARFSGSGSRTDFTLTINPVEADDVATYYC QQSNEAPPTFGGGTKLEIK |
| 182 | BA-01 (LYPD3) VH | EVQLLESGGGLVQPGGSLRLSCAASGFTFSNAWMSWVRQAPGKG LEWVSYISSSGSTIYYADSVKGRFTISRDNSKNTLYLQMNSLRAED TAVYYCAREGLWAFDYWGQGTLVTVTS |
| 183 | BA-01 (LYPD3) VL | QSVLTQPPSASGTPGQRVTISCTGSSSNIGAGYVVHWYQQLPGTA PKLLIYDNNKRPSGVPDRFSGSKSGTSASLAISGLASEDEADYYCA AWDDRLNGPVFGGGTKLTVL |
| 184 | FR-01 (DSG3) VH | EVQLQQSGTVLARPGASVKMSCKASGYTFASYWIHWVKQRPGQ GLEWIGSIYPGNSDTTYNQKFKGKAKLTVVTSASSAYMELSSLTN EDSAVYYCTEPTYYSYDDYYAMDYWGQGTSVTVSS |
| 185 | FR-01 (DSG3) VL | EIVLTQSPALMAASPGEKVTITCSVSSSISSSNLHWYQQKSGTSPKP WIYGTSNLASGVPVRFSGSGSGTSYSLTISTMEAEDAATYYCQQW SSYPLTFGAGTKLELK |

Illustrative, non-limiting examples of tissue-specific Wnt signal enhancing molecules include fusion proteins comprising: 1) a first domain comprising an R-spondin Furin domain 1 or variant thereof and a second domain comprising an antibody or fragment thereof that specifically binds ASGR1 or ASGR2; 2) a first domain comprising an R-spondin Furin domain 1 or variant thereof and a second domain comprising an antibody or fragment thereof that specifically binds SLC10A1; 3) a first domain comprising an R-spondin Furin domain 1 or variant thereof and a second domain comprising an antibody or fragment thereof that specifically binds TFR2; 4) a first domain comprising an R-spondin Furin domain 1 or variant thereof and a second domain comprising a ligand derivative, an antibody or fragment thereof that specifically binds PTH1R; 5) a first domain comprising an R-spondin Furin domain 1 or variant thereof and a second domain comprising a ligand derivative, an antibody or fragment thereof that specifically binds LYPD3; 6) a first domain comprising an R-spondin Furin domain 1 or variant thereof and a second domain comprising a ligand derivative, an antibody or fragment thereof that specifically binds DSG3; and 7) a first domain comprising an R-spondin Furin domain 1 or variant thereof and a second domain comprising a ligand derivative, an antibody or fragment thereof that specifically binds TFR1. Additional, illustrative, non-limiting examples of tissue-specific Wnt signal enhancing molecules include fusion proteins comprising: 1) a first domain comprising an antibody or fragment thereof that specifically binds ZNRF3 and/or RNF43, and a second domain comprising an antibody or fragment thereof that specifically binds ASGR1 or ASGR2; 2) a first domain comprising an antibody or fragment thereof that specifically binds ZNRF3 and/or RNF43, and a second domain comprising an antibody or fragment thereof that specifically binds SLC10A1; 3) a first domain comprising an antibody or fragment thereof that specifically binds ZNRF3 and/or RNF43, and a second domain comprising an antibody or fragment thereof that specifically binds TFR2; 4) a first domain comprising an antibody or fragment thereof that specifically binds ZNRF3 and/or RNF43, and a second domain comprising a ligand derivative, an antibody or fragment thereof that specifically binds PTH1R; 5) a first domain comprising an antibody or fragment thereof that specifically binds ZNRF3 and/or RNF43, and a second domain comprising a ligand derivative, an antibody or fragment thereof that specifically binds LYPD3; 6) a first domain comprising an antibody or fragment thereof that specifically binds ZNRF3 and/or RNF43, and a second domain comprising a ligand derivative, an antibody or fragment thereof that specifically binds DSG3; and 7) a first domain comprising an antibody or fragment thereof that specifically binds ZNRF3 and/or RNF43, and a second domain comprising a ligand derivative, an antibody or fragment thereof that specifically binds TFR1. In particular embodiments, the first domain comprises an antibody comprising any of the sets of heavy chain or light chain CDR sequences set forth in Table 2, and/or the second domain comprises an antibody comprising any of the sets of heavy chain or light chain CDR sequences set forth in Table 3. In particular embodiments, the two domains are joined via a linker, e.g., a polypeptide linker. In certain embodiments, the linker is albumin, e.g., human serum albumin, where the targeting and action modules are on the N- and C-termini of albumin. In particular embodiments, the tissue-specific Wnt signal enhancing molecules have an appended antibody (e.g., IgG) format comprising an antibody heavy chain and an antibody light chain (or fragments or variants thereof of either or both chains), wherein one or both chains further comprises one or more additional binding domain. In particular embodiments, the tissue-specific Wnt signal enhancing molecules have an appended antibody (e.g., IgG) format, wherein the second domain comprises an antibody heavy chain and an antibody light chain (or fragments or variants thereof of either or both chains), and wherein a first domain comprising an R-spondin Furin domain 1 or variant is appended to one or both of the antibody heavy and/or light chains, e.g., at either or both the N-terminus and/or C-terminus of either or both chains. In particular embodiments, the first domain is appended or fused to the heavy chain, e.g., at either the N-terminus or C-terminus. In particular embodiments, the first domain is appended or fused to the light chain, e.g., at either the N-terminus or C-terminus).

Linkers

In certain embodiments, the targeting module and the action module are bound or fused directly to each other, whereas in other embodiments, they are separated by a linker, e.g., a polypeptide linker, or a non-peptidyl linker, etc. In particular embodiments, a linker is an Fc linker, e.g., a region of an antibody Fc domain capable of dimerizing with another Fc linker, e.g., via one or more disulfide bonds. In another particular embodiment, a linker is albumin, e.g., human serum albumin, where the targeting and action modules are on the N- and C-termini of albumin.

In certain embodiments, particularly when joining two polypeptides, the linker is made up of amino acids linked together by peptide bonds. In particular embodiments, the linker comprises, in length, from 1 up to about 40 amino acid residues, from 1 up to about 20 amino acid residues, or from 1 to about 10 amino acid residues. In certain embodiments, the amino acid residues in the linker are from among the twenty canonical amino acids, and in certain embodiments, selected from cysteine, glycine, alanine, proline, asparagine, glutamine, and/or serine. In certain embodiments, a linker comprises one or more non-natural amino acids. In some embodiments, a peptidyl linker is made up of a majority of amino acids that are sterically unhindered, such as glycine, serine, and alanine linked by a peptide bond. Certain linkers include polyglycines, polyserines, and polyalanines, or combinations of any of these. Some exemplary peptidyl linkers are poly(Gly)1-8, particularly (Gly)3, (Gly)4 (SEQ ID NO:698), (Gly)5 (SEQ ID NO:699) and (Gly)7 (SEQ ID NO:700), as well as, poly(Gly)4 Ser (SEQ ID NO:701), poly(Gly-Ala)2-4 and poly(Ala)1-8. Other specific examples of peptidyl linkers include (Gly)5Lys (SEQ ID NO:702), and (Gly)5LysArg (SEQ ID NO:703). To explain the above nomenclature, for example, (Gly)3Lys(Gly)4 (SEQ ID NO:704) means Gly-Gly-Gly-Lys-Gly-Gly-Gly-Gly (SEQ ID NO:704). Other combinations of Gly and Ala are also useful. Additionally, a peptidyl linker can also comprise a non-peptidyl segment such as a 6 carbon aliphatic molecule of the formula —CH2-CH2-CH2-CH2-CH2-CH2-. The peptidyl linkers can be altered to form derivatives as described herein.

Illustrative non-peptidyl linkers include, for example, alkyl linkers such as —NH—(CH2) s-C(O)—, wherein s=2–20. These alkyl linkers may further be substituted by any non-sterically hindering group such as lower alkyl (e.g., C1-C6) lower acyl, halogen (e.g., Cl, Br), CN, NH2, phenyl, etc. Non-peptide portions of the inventive composition of matter, such as non-peptidyl linkers or non-peptide half-life extending moieties can be synthesized by conventional organic chemistry reactions. Chemical groups that find use in linking binding domains include carbamate; amide (amine plus carboxylic acid); ester (alcohol plus carboxylic acid), thioether (haloalkane plus sulfhydryl; maleimide plus sulfhydryl), Schiff's base (amine plus aldehyde), urea (amine plus isocyanate), thiourea (amine plus isothiocyanate), sulfonamide (amine plus sulfonyl chloride), disulfide; hydrazone, lipids, and the like, as known in the art.

The linkage between domains may comprise spacers, e.g. alkyl spacers, which may be linear or branched, usually linear, and may include one or more unsaturated bonds; usually having from one to about 300 carbon atoms; more usually from about one to 25 carbon atoms; and may be from about three to 12 carbon atoms. Spacers of this type may also comprise heteroatoms or functional groups, including amines, ethers, phosphodiesters, and the like. Specific structures of interest include: $(CH_2CH_2O)n$ where n is from 1 to about 12; $(CH_2CH_2NH)_n$, where n is from 1 to about 12; $[(CH_2)n(C=O)NH(CH_2)_m]_z$, where n and m are from 1 to about 6, and z is from 1 to about 10; $[(CH_2)nOPO_3(CH_2)_m]_z$ where n and m are from 1 to about 6, and z is from 1 to about 10. Such linkers may include polyethylene glycol, which may be linear or branched.

In certain embodiments, the domains may be joined through a homo- or heterobifunctional linker. Illustrative entities include: azidobenzoyl hydrazide, N-[4-(p-azidosalicylamino)butyl]-3'-[2'-pyridyldithio]propionamide), bis-sulfosuccinimidyl suberate, dimethyladipimidate, di succinimidyltartrate, N-γ-maleimidobutyryloxysuccinimide ester, N-hydroxy sulfosuccinimidyl-4-azidobenzoate, N-succinimidyl [4-azidophenyl]-1,3'-dithiopropionate, N-succinimidyl [4-iodoacetyl]aminobenzoate, glutaraldehyde, NETS-PEG-MAL; succinimidyl 4-[N-maleimi domethyl]cyclohexane-1-carboxylate; 3-(2-pyridyldithio) pyridyldithio) propionic acid N-hydroxysuccinimide ester (SPDP); N, N'-(1,3-phenylene) bismaleimide; N, N'-ethylene-bis-(iodoacetamide); or 4-(N-maleimidomethyl)-cyclohexane-1-carboxylic acid N-hydroxysuccinimide ester (SMCC); m-maleimidobenzoyl-N-hydroxysuccinimide ester (MB S), and succinimide 4-(p-maleimidophenyl)butyrate (SMPB), an extended chain analog of MBS. In certain embodiments, the succinimidyl group of these cross-linkers reacts with a primary amine, and the thiol-reactive maleimide forms a covalent bond with the thiol of a cysteine residue.

Other reagents useful include: homobifunctional cross-linking reagents including bismaleimidohexane ("BMH"); p,p'-difluoro-m,m'-dinitrodiphenylsulfone (which forms irreversible cross-linkages with amino and phenolic groups); dimethyl adipimidate (which is specific for amino groups); phenol-1,4-disulfonylchloride (which reacts principally with amino groups); hexamethylenediisocyanate or diisothiocyanate, or azophenyl-p-diisocyanate (which reacts principally with amino groups); disdiazobenzidine (which reacts primarily with tyrosine and histidine); O-benzotriazolyloxy tetramethuluronium hexafluorophosphate (HATU), dicyclohexyl carbodiimde, bromo-tris (pyrrolidino) phosphonium bromide (PyBroP); N,N-dimethylamino pyridine (DMAP); 4-pyrrolidino pyridine; N-hydroxy benzotriazole; and the like.

Antibodies and Uses Thereof

In various embodiments, the present invention provides anti-RNF43, anti-ZNRF3, and anti-ASGR1/2 antibodies and antigen-binding fragments thereof and related methods of use.

In one embodiments, the disclosure provides an isolated antibody, or an antigen-binding fragment thereof, that binds to RNF43, ZNRF3, ASGR1, or ASGR2 (optionally human), comprising a sequence comprising: (i) CDRH1, CDRH2 and CDRH3 sequences set forth for any of the antibodies of Table 2A or 3A; and/or (ii) CDRL1, CDRL2 and CDRL3 sequences set forth for any of the antibodies of Table 2A or 3A, or a variant of said antibody, or antigen-binding fragment thereof, comprising one or more amino acid modifications, wherein said variant comprises less than 8 amino acid substitutions in said CDR sequences. In particular embodiments, the antibody or antigen-binding fragment thereof comprises a heavy chain variable region comprising an amino acid sequence having at least 90% identity to the amino acid sequence set forth in Table 2B or Table 3B or a heavy chain variable region comprising the amino acid sequence set forth in Table 2B or Table 3B. In particular embodiments, the antibody, or antigen-binding fragment thereof, comprises a light chain variable region comprising an amino acid sequence having at least 90% identity to the amino acid sequence set forth in Table 2B or Table 3B or a light chain variable region comprising the amino acid sequence set forth in Table 2B or Table 3B.

In particular embodiments, any of the antibodies, or antigen-binding fragments thereof, are humanized. In certain embodiments, any of the antibodies, or antigen-binding fragments thereof, are a single chain antibody, a scFv, a univalent antibody lacking a hinge region, a nanobody, or a minibody. In particular embodiments, any of the antibodies, or antigen-binding fragments thereof, are a VHH nanobody. In particular embodiments, any of the antibodies, or antigen-binding fragments thereof, are a Fab or a Fab' fragment.

In certain embodiments, any of the antibodies, or antigen-binding fragments thereof, are a fusion protein.

In a related embodiment, the disclosure provides an isolated antibody, or an antigen-binding fragment thereof, that competes with any of the antibodies disclosed herein for binding to its target ZNRF3, RNF43 or ASGR1/2. In particular embodiments, any of the antibodies, or antigen-binding fragments thereof, bind to its target with a KD of 50 µM or lower.

In one embodiment, the invention comprises an isolated antibody or antigen-binding fragment thereof that binds to human ASGR and inhibits ASGR binding to ligand. In another embodiment, the invention comprises an isolated antibody or antigen-binding fragment thereof that binds to human ASGR-1 and inhibits ASGR-1 binding to ligand and/or ASGR-1 interaction with ASGR-2. In another embodiment, the invention comprises an isolated antibody or antigen-binding fragment thereof that binds to human ASGR-2 and inhibits ASGR-2 binding to ligand and/or ASGR-2 interaction with ASGR-1. In yet another embodiment, the invention comprises an isolated antibody or antigen-binding fragment thereof that binds to human ASGR-1 and human ASGR-2, and inhibits ASGR-1 and/or ASGR-2 binding to ligand. In some embodiments, the isolated antibody or antigen-binding fragment thereof binds specifically to human ASGR, ASGR-1 and/or ASGR-2.

In particular embodiments, any of the antibodies, or antigen-binding fragments thereof, modulate a Wnt signaling pathway in a cell, optionally a mammalian cell. In particular embodiments, any of the antibodies, or antigen-binding fragments thereof increase signaling via a Wnt signaling pathway in the cell. In particular embodiments, any of the antibodies, or antigen-binding fragments thereof decrease signaling via a Wnt signaling pathway in the cell. In certain embodiments, the Wnt signaling pathway is a canonical Wnt signaling pathway or a non-canonical Wnt signaling pathway.

In a further related embodiment, the present disclosure provides an isolated polynucleotide encoding an antibody, or antigen-binding fragment thereof, disclosed herein. In certain embodiments, the present disclosure provides an expression vector comprising the isolated polynucleotide and an isolated host cell comprising the expression vector.

In another embodiment, the present disclosure provides a pharmaceutical composition comprising a physiologically acceptable excipient, diluent, or carrier, and a therapeutically effective amount of the isolated antibody, or antigen-binding fragment thereof, disclosed herein.

The present disclosure provides methods for detecting the presence of or expression levels of ZNRF3, RNF43 or ASGR1/2 polypeptides, e.g., in a biological sample (e.g., cells or tissue), comprising contacting the biological sample with an antibody or antigen-binding fragment thereof disclosed herein that specifically binds the target polypeptide. In certain embodiments, the antibody or antigen-binding fragment thereof is detectable labeled, e.g., by a fluorescent tag. Accordingly, the antibodies may be used to stain cells expressing the antibody target polypeptides. For example, the anti-ASGR1/2 antibodies and antigen-binding fragments thereof may be used to detect or stain hepatocytes.

The antibodies or antigen-binding fragments thereof disclosed herein may also be used to deliver drugs to the cells that they bind. For example, the anti-ASGR1/2 antibodies and antigen-binding fragments thereof may be conjugated to a therapeutic agent to deliver the therapeutic agent to liver cells, e.g., normal or cancer liver cells.

In a further embodiment, the present disclosure provides a method for agonizing a Wnt signaling pathway in a cell, comprising contacting the cell with an isolated antibody, or antigen-binding fragment thereof, disclosed herein that increases Wnt signaling. In another embodiment, the present disclosure provides a method for inhibiting a Wnt signaling pathway in a cell, comprising contacting the cell with the isolated antibody, or antigen-binding fragment thereof, disclosed herein the inhibits Wnt signaling.

In another embodiment, the present disclosure includes a method for treating a subject having a disease or disorder associated with reduced Wnt signaling, comprising administering to the subject an effective amount of a pharmaceutical composition comprising an isolated antibody, or antigen-binding fragment thereof, disclosed herein that is an agonist of a Wnt signaling pathway. In particular embodiments, the disease or disorder is any of those described herein as being treated by a tissue-specific Wnt signal enhancing molecule.

In some embodiments, the disclosure includes a method of decreasing the risk of acquiring coronary artery disease or having an MI comprising administering to a subject in need thereof a therapeutically effective dose of an anti-ASGR antibody or antigen-binding fragment thereof disclosed herein. In some embodiments, the antibody binds ASGR-1, and in some embodiments, the antibody binds ASGR-2. In some embodiments, the antibody is an inhibitor of ASGR-1 and/or ASGR-2. In some embodiments, the relative risk reduction of coronary artery disease or MI is at least about 5%, at least about 10%, at least about 15%, at least about 20%, at least about 25%, at least about 30%, at least about 35%, at least about 40%, at least about 45%, at least about 50%, at least about 55%, at least about 60% in the treated subject as compare to an untreated subject.

In some embodiments, the disclosure provides a method of reducing blood LDL cholesterol levels in a subject comprising administering to a subject in need thereof a therapeutically effective dose of an anti-ASGR antibody or antigen-binding fragment thereof disclosed herein. In some embodiments, the antibody binds ASGR-1, and in some embodiments, the antibody binds ASGR-2. In some embodiments, the antibody is an inhibitor of ASGR-1 and/or ASGR-2. In some embodiments, the blood LDL cholesterol level in the treated subject is reduced by at least about 15%, as compared to a predose level of blood LDL cholesterol in the subject. In some embodiments of this aspect of the invention, the blood LDL cholesterol level of said subject is lowered by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of blood LDL cholesterol in the subject.

In some embodiments, the disclosure provides a method of reducing non-HDL cholesterol levels in a subject comprising administering to a subject in need thereof a therapeutically effective dose of an anti-ASGR antibody or antigen-binding fragment thereof disclosed herein. In some embodiments, the antibody binds ASGR-1, and in some embodiments, the antibody binds ASGR-2. In some embodiments, the antibody is an inhibitor of ASGR-1 and/or ASGR-2. In some embodiments, the non-HDL cholesterol level in the subject is reduced by at least about 5%, as compared to a predose level of non-HDL cholesterol in the subject. In some embodiments of this aspect of the invention, the non-HDL cholesterol level of said patient is lowered by at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose level of non-HDL cholesterol in the patient.

In some embodiments, the disclosure provides a method of increasing ALP levels through inhibition of ASGR activity, in a patient comprising administering to a subject in need thereof a therapeutically effective dose of an anti-ASGR antibody or antigen-binding fragment thereof disclosed herein. In some embodiments, the antibody binds ASGR-1, and in some embodiments, the antibody binds ASGR-2. In some embodiments, the antibody is an inhibitor of ASGR-1 and/or ASGR-2. In some embodiments, the ALP level in the patient is increased by at least about 30%, as compared to a predose level of ALP in the patient. In some embodiments of this aspect of the invention, the ALP level of said subject is increased by at least about at least about 35%, at least about 40%, at least about 45%, at least about 50%, at least about 55%, at least about 60%, at least about 65%, at least about 70%, at least about 75%, at least about 80%, at least about 85%, or at least about 90% as compared to a predose ALP level in the subject. In some embodiments, ALP levels are increased at least about 1.25-fold, 1.5-fold, 2-fold, 2.5-fold, 3-fold, 3.5-fold, 4-fold, 4.5-fold, and 5-fold over pretreatment.

In some embodiments, the disclosure provides a method of antagonizing ASGR, ASGR-1 and/or ASGR-2 in a subject, comprising administering to a subject in need thereof a therapeutically effective dose of an anti-ASGR antibody or antigen-binding fragment thereof disclosed herein. In some embodiments, the antibody binds ASGR-1, and in some embodiments, the antibody binds ASGR-2. In some embodiments, the antibody is an inhibitor of ASGR-1 and/or ASGR-2.

In some embodiments, a method of treating or preventing a cardiovascular disease is provided and comprises administering to a subject in need thereof a therapeutically effective dose of an anti-ASGR antibody or antigen-binding fragment thereof disclosed herein. In some embodiments, the antibody binds ASGR-1, and in some embodiments, the antibody binds ASGR-2. In some embodiments, the antibody is an inhibitor of ASGR-1 and/or ASGR-2. In some embodiments, the relative risk reduction of a cardiovascular event is at least about 5%, at least about 10%, at least about 15%, at least about 20%, at least about 25%, at least about 30%, at least about 35%, at least about 40%, at least about 45%, at least about 50%, at least about 55%, at least about 60% in the patient.

Wnt Molecules, Norrin Molecules, and Wnt Signal Enhancing Molecules

The present disclosure further relates to Wnt polypeptides, Norrin polypeptides, and Wnt signaling agonist molecules and their use to increase Wnt signaling and treat or prevent Wnt-related diseases or disorders, including those described herein. In certain embodiments, the Wnt polypeptides, Norrin polypeptides and Wnt signaling agonist molecules are provided to a subject alone or in combination with one or more tissue-specific Wnt signal enhancing molecules described herein.

Wnt polypeptides and Wnt-encoding polynucleotide sequences are known in the art and include any and all Wnt polypeptides or polynucleotides, including those of any and all species, including mammalian Wnt polypeptides and polynucleotides, such as human Wnt polypeptides and polynucleotides. Illustrative Wnt polypeptides include Wnt1, Wnt2, Wnt2B, Wnt3, Wnt3A, Wnt4, Wnt5A, Wnt5B, Wnt6, Wnt7A, Wnt7B, Wnt8A, Wnt8B, Wnt9A, Wnt9B, Wnt10A, Wnt10B, Wnt11, and Wnt16, and functional variants and fragments of any of the foregoing. Wnt polypeptide encompasses native Wnt polypeptides, Wnt polypeptide variants, Wnt polypeptide fragments and chimeric Wnt polypeptides. In particular embodiments, a Wnt polypeptide is a native human full length mature Wnt protein.

For example, human native sequence Wnt proteins of interest in the present application include but are not limited to the following: Wnt1 (GenBank Accession No. NM_005430); Wnt-2 (GenBank Accession No NM_003391); Wnt2B (Wnt-13) (GenBank Accession No. NM_004185 (isoform 1), NM_024494.2 (isoform 2)), Wnt3 (RefSeq.: NM_030753), Wnt3A (GenBank Accession No. NM_033131), Wnt4 (GenBank Accession No. NM_030761), Wnt5A (GenBank Accession No. NM_003392), Wnt5B (GenBank Accession No. NM_032642), Wnt6 (GenBank Accession No. NM_006522), Wnt7A (GenBank Accession No. NM_004625), Wnt7B (GenBank Accession No. NM_058238), Wnt8A (GenBank Accession No. NM_058244), Wnt8B (GenBank Accession No. NM_003393), Wnt9A (Wnt-14) (GenBank Accession No. NM_003395), Wnt9B (Wnt15) (GenBank Accession No. NM_003396), Wnt1 OA (GenBank Accession No. NM_025216), Wnt10B (GenBank Accession No. NM_003394), Wnt11 (GenBank Accession No. NM_004626), Wnt16 (GenBank Accession No. NM_016087)). Although each member has varying degrees of sequence identity with the family, all encode small (i.e., 39-46 kD), acylated, palmitoylated, secreted glycoproteins that contain 23-24 conserved cysteine residues whose spacing is highly conserved (McMahon, A P et al., Trends Genet. 1992; 8: 236-242; Miller, J R. Genome Biol. 2002; 3(1): 3001.1-3001.15). Other native sequence Wnt polypeptides of interest include orthologs of the above from any mammal, including domestic and farm animals, and zoo, laboratory or pet animals, such as dogs, cats, cattle, horses, sheep, pigs, goats, rabbits, rats, mice, frogs, zebra fish, fruit fly, worm, etc.

Norrin polypeptides and Norrin-encoding polynucleotide sequences are also known in the art and include any species of Norrin polypeptide or polynucleotide, including mammalian Norrin polypeptides and polynucleotides, such as human Norrin polypeptides and polynucleotides, and functional variants and fragments thereof.

Wnt signaling agonist molecules include any type of molecule that agonizes Wnt signaling. In particular embodiments, the Wnt signaling agonist molecule is described in PCT Patent Application Publication No. WO 2016/040895. A Wnt signaling agonist can be any molecule, e.g. protein or pharmaceutical (e.g., small organic molecule), in certain embodiments water soluble, which directly activates the canonical Wnt signaling through binding to one or more Fzd proteins and to Lrp5/6. In particular embodiments, they are small molecules, which may be less than about 15 Kd. In other embodiments, they are polypeptides. In addition, certain Wnt signaling agonists may comprise both a polypeptide region or domain and a non-polypeptide region or domain.

In some embodiments of the invention, the Wnt signaling agonist molecule is a polypeptide, which can comprise separate or contiguous binding domains or elements for Fzd, and for Lrp5/6. A polypeptide Wnt signaling agonist may be a single chain, dimer, or higher order multimer. The Fzd binding domain/element and the Lrp5/6 binding domain/element may be directly joined, or may be separated by a linker, e.g. a polypeptide linker, or a non-peptidic linker, etc.

In polypeptide embodiments, the Fzd binding domain may be selected from any domain that binds Fzd at high affinity, e.g. a KD of at least about 1×10-7 M, at least about 1×10-8 M, at least about 1×10-9 M, or at least about 1×10-10 M. Suitable Fzd binding domains include, without limitation, de novo designed Fzd binding proteins, antibody derived binding proteins, e.g. scFv, Fab, etc. and other portions of antibodies that specifically bind to one or more Fzd proteins; nanobody derived binding domains; knottin-based engineered scaffolds; Norrin and engineered binding fragments derived therefrom, naturally occurring Fzd binding domains, and the like.

In some embodiments the Fzd binding domain binds to one, two, three, four, five or more different frizzled proteins, e.g. one or more of human frizzled proteins Fz1, Fz2, Fz3, Fz4, Fz5, Fz6, Fz7, Fz8, Fz9, Fz10. In some embodiments the antibody based signaling agonist binds to Fz1, Fz2, Fz5, Fz7 and Fz8. In other embodiments the frizzled binding moiety is selective for one or more frizzled protein of interest, e.g. having a specificity for the one or more desired frizzled protein of at least 10-fold, 25-fold, 50-fold, 100-fold, 200-fold or more relative to other frizzled proteins.

In certain embodiments, the frizzled binding domain comprises the six CDR regions of the pan specific frizzled antibody OMP-18R5 (vantictumab). In certain embodiments, the frizzled binding domain is an scFv comprising the six CDR regions of the pan-specific frizzled antibody OMP-18R5 (vantictumab). See, for example, U.S. Pat. No. 8,507,442, herein specifically incorporated by reference. For example, the CDR sequences of OMP-18R5 include a heavy chain CDR1 comprising GFTFSHYTLS (SEQ ID NO:705), a heavy chain CDR2 comprising VISGDGSYTYY-ADSVKG (SEQ ID NO:706), and a heavy chain CDR3 comprising NFIKYVFAN (SEQ ID NO:707), and (ii) a light chain CDR1 comprising SGDKLGKKYAS (SEQ ID NO:708) or SGDNIGSFYVH (SEQ ID NO:709), a light chain CDR2 comprising EKDNRPSG (SEQ ID NO:710) or DKSNRPSG (SEQ ID NO:711), and a light chain CDR3 comprising SSFAGNSLE (SEQ ID NO:712) or QSY-ANTLSL (SEQ ID NO:713). In particular embodiments, the frizzled binding domain is an antibody or derivative thereof, including without limitation ScFv, minibodies, nanobodies and various antibody mimetics comprising CDR sequences of OMP-18R5. In certain embodiments, these CDR sequences comprise one or more amino acid modifications as compared to the CDR sequences of OMP-18R5.

In other embodiments, the Fzd binding domain comprises a variable region sequence, or the CDRs thereof, from any of a number of frizzled specific antibodies, which are known in the art and are commercially available, or can be generated de novo. Any of the frizzled polypeptides can be used as an immunogen or in screening assays to develop an antibody. "Fz", "Fz proteins" and "Fz receptors" is used herein to refer to proteins of the Frizzled receptor family. These proteins are seven-pass transmembrane proteins (Ingham, P. W. (1996) Trends Genet. 12: 382-384; Yang-Snyder, J. et al. (1996) Curr. Biol. 6: 1302-1306; Bhanot, P. et al. (1996) Nature 382: 225-230) that comprise a CRD domain. There are ten known members of the Fz family (Fz1 through Fz10), any of which can serve as receptors of Wnts. The Genbank accession numbers of human frizzled reference sequences are as follows: FZD1 (NM_003505); FZD2 (NM_001466); FZD3 (NM_145866); FZD4 (NM_012193); FZD5 (NM_003468); FZD6 (NM_003506); FZD7 (NM_003507); FZD8 (NM_031866); FZD9 (NM_003508); FZD10 (NM_007197). [0076] Non-limiting examples of frizzled binding domains include antibodies available from Biolegend, e.g. Clone CH3A4A7 specific for human frizzled 4 (CD344); Clone W3C4E11 specific for human Fz9 (CD349); antibodies available from Abcam, e.g. ab64636 specific for Fz7; ab83042 specific for human Fz4; ab77379 specific for human Fz7; ab75235 specific for human Fz8; ab102956 specific for human Fz9; and the like. Other examples of suitable antibodies are described in, inter alia, US Patent application 20140105917; US Patent application 20130230521; US Patent application 20080267955; US Patent application 20080038272; US Patent application 20030044409.

The frizzled binding moiety of the surrogate may be an engineered protein that is selected for structural homology to the frizzled binding region of a Wnt protein. Such proteins can be identified by screening a structure database for homologies. The initial protein thus identified, for example the microbial Bh1478 protein. The native protein is then engineered to provide amino acid substitutions that increase affinity, and may further be selected by affinity maturation for increased affinity and selectivity in binding to the desired frizzled protein. Non-limiting examples of frizzled binding moieties include the Fz27 and Fz27-B12 proteins illustrated in FIG. 1 of PCT Patent Application Publication No. WO 2016/040895.

In certain polypeptide embodiments, the Lrp5/6 binding domain or element may be selected from any domain that binds Lrp5/6 at high affinity, e.g. a $K_D$ of at least about $1 \times 10^{-7}$ M, at least about $1 \times 10^{-8}$ M, at least about $1 \times 10^{-9}$ M, at least about $1 \times 10^{-10}$ M. Suitable Lrp5/6 binding domains include, without limitation, de novo designed Lrp5/6 binding proteins, antibody derived binding proteins, e.g. scFv, Fab, etc. and other portions of antibodies that specifically bind to one or more Fzd proteins; nanobody derived binding domains; knottin-based engineered scaffolds; naturally occurring Lrp5/6 binding proteins or polypeptides, including without limitation, Norrin, DKK1, DKK2, DKK3, DKK4, sclerostin; and the like. In certain embodiments the Lrp5/6 binding domain is a C-terminal portion of DKK1.

An Lrp5/6 binding domain may be selected from any domain that binds Lrp5 or Lrp6 at high affinity, e.g. with a $K_D$ of at least about $1 \times 10^{-7}$ M, at least about $1 \times 10^{-8}$ M, at least about $1 \times 10^{-9}$ M, at least about $1 \times 10^{-10}$ M1. "LRP", "LRP proteins" and "LRP receptors" is used herein to refer to proteins of the low density lipoprotein receptor-related protein family. These receptors are single-pass transmembrane proteins that bind and internalize ligands in the process of receptor-mediated endocytosis. LRP proteins LRP5 (GenBank Accession No. NM 002335.2) and LRP6 (GenBank Accession No. NM_002336.2) are included in the Wnt receptor complex.

Suitable Lrp5/6 binding domains include, without limitation, de novo designed Lrp5/6 binding proteins, antibody derived binding proteins, e.g., scFv, Fab, etc. and other portions of antibodies that specifically bind to one or more Fzd proteins; nanobody derived binding domains; knottin-based engineered scaffolds; naturally occurring Lrp5/6, including without limitation, DKK1, DKK2, DKK3, DKK4, sclerostin; Wise; fusions proteins comprising any of the above; derivatives of any of the above; variants of any of the above; and biologically active fragments of any of the above, and the like. A Lrp5/6 binding domain may be affinity selected to enhance binding.

Members of the Dickkopf (Dkk) gene family (see Krupnik et al. (1999) Gene 238(2):301-13) include Dkk-1, Dkk-2, Dkk-3, and Dkk-4, and the Dkk-3 related protein Soggy (Sgy). hDkks 1-4 contain two distinct cysteine-rich domains in which the positions of 10 cysteine residues are highly conserved between family members. Exemplary sequences of human Dkk genes and proteins are publicly available, e.g., Genbank accession number NM_014419 (soggy-1); NM_014420 (DKK4); AF177394 (DKK-1); AF177395 (DKK-2); NM_015881 (DKK3); and NM_014421 (DKK2). In some embodiments of the invention, the Lrp6 binding moiety is a DKK1 peptide, including without limitation the C-terminal domain of human DKK1. As shown in FIG. 5, the C-terminal domain may comprise the sequence KMYHTKGQEGSVCLRS SDCASGLCCA-RHFWSKICKPVLKEGQVCTKHRRKGSHGLE IFQRC YCGEGLSCRIQKDHHQASNSSRLHTCQRH (SEQ ID NO:714) (see Genbank accession number NP 036374) or a biologically active fragment thereof.

Binding of DKK proteins to LRP5/6 are discussed, for example in Brott and Sokol Mol. Cell. Biol. 22 (17), 6100-6110 (2002); and Li et al. J. Biol. Chem. 277 (8), 5977-5981 (2002), each herein specifically incorporated by reference. The corresponding region of human DKK2 (Genbank reference NP 055236) may comprise the sequence KMSHIKGHEGDPCLRS SDCIEGFCCARHFWTKICK-PVLHQGEVCTKQRKKGSHGLEI FQRCD-CAKGLSCKVWKDATYSSKARLHVCQK (SEQ ID NO:715) or a biologically active fragment thereof.

Antibodies that specifically bind to Lrp5 or Lrp6 are known in the art and are commercially available, or can be generated de novo. Lrp5, Lrp6 or fragments thereof can be used as an immunogen or in screening assays to develop an antibody. Examples of known antibodies include, without limitation, those described in Gong et al. (2010) PLoS One. 5(9):e12682; Ettenberg et al. (2010) Proc Natl Acad Sci USA. 107(35): 15473-8; and those commercially available from, for example Santa Cruz biotechnology antibody clone 1A12, which was raised against synthetic LRP5/6 of human origin and binds to both the full length and proteolytic fragment of LRP 6 and LRP 5 of mouse and human origin; the monoclonal antibody 2B11; Cell Signaling Technology antibody specific for LRP5 (D80F2), catalog number 5731; etc.

Polypeptides and binding domains may also include derivatives, variants, and biologically active fragments of polypeptides described above. A "variant" polypeptide means a biologically active polypeptide as defined below having less than 100% sequence identity with a provided sequence. Such variants include polypeptides comprising one or more amino acid modifications, e.g., insertions, deletions or substitutions, as compared to the provided sequence, e.g., wherein one or more amino acid residues are added at the N- or C-terminus of, or within, the native sequence; from about one to forty amino acid residues are deleted, and optionally substituted by one or more amino acid residues; and derivatives of the above polypeptides, wherein an amino acid residue has been covalently modified so that the resulting product has a non-naturally occurring amino acid. In certain embodiments, a biologically active variant will have an amino acid sequence having at least about 90% amino acid sequence identity with a native sequence polypeptide, at least about 95%, or at least about 99%. A "functional variant" of a sequence is a compound having a qualitative biological property in common with an initial sequence. "Functional variants" include, but are not limited to, fragments of a sequence and variants of a sequence, provided that they have a biological activity in common. The term "variant" encompasses both amino acid sequence variants of polypeptide and covalent modifications thereof.

The Fzd binding domain and the Lrp5/6 binding domain may be contiguous within one globular domain, or separated by a linker, e.g. a polypeptide linker, or a non-peptidic linker, etc., including but not limited to any of those described herein. The length of the linker, and therefore the spacing between the binding domains can be used to modulate the signal strength, and can be selected depending on the desired use of the Wnt signaling agonist. The enforced distance between binding domains can vary, but in certain embodiments may be less than about 100 angstroms, less than about 90 angstroms, less than about 80 angstroms, less than about 70 angstroms, less than about 60 angstroms, or less than about 50 angstroms.

In some embodiments the linker is a rigid linker, in other embodiments the linker is a flexible linker. Where the linker is a peptide linker, in certain embodiments, it may be from about 1, 2, 3, 4, 5, 6, 7, 8, 9, 10, 11, 12, 13, 14, 15, 16, 17, 18, 19, 20 21, 22, 23, 24, 25, 26, 27, 28, 29, 30 or more amino acids in length, and is of sufficient length and amino acid composition to enforce the distance between binding domains. In some embodiments the linker comprises or consists of one or more glycine and/or serine residues.

The present disclosure also includes polynucleotides or nucleic acid sequences that encode one or more Wnt polypeptide, Norrin polypeptide, or Wnt signaling agonist molecule, and vectors comprising these polynucleotides, including expression vectors, and cells comprising these vectors. In certain embodiments, the polynucleotides or nucleic acid sequences are DNA or RNA. In particular embodiments, the RNA is messenger RNA (mRNA). In certain embodiments, the RNA is a modified mRNA comprising one or more modified nucleosides. Modified mRNAs comprising one or more modified nucleoside have been described as having advantages over unmodified mRNAs, including increase stability, higher expression levels and reduced immunogenicity. Non-limiting examples of modified mRNAs that may be used according to the present invention are described, e.g., in PCT Patent Application Publication Nos. WO2011/130624, WO02012/138453, WO2013052523, WO2013151666, WO2013/071047, WO2013/078199, WO2012045075, WO2014081507, WO2014093924 WO2014164253, U.S. Pat. No. 8,278,036 (describing modified mRNAs comprising pseudouridine), U.S. Pat. No. 8,691,966 (describing modified mRNAs comprising pseudouridine and/or N1-methylpseudouridine), U.S. Pat. No. 8,835,108 (describing modified mRNAs comprising 5-methylcytidine, U.S. Pat. No. 8,748,089 (describing modified mRNAs comprising pseudouridine or 1-methylpseudouridine). In particular embodiments, the modified mRNA sequence encoding the Wnt polypeptide, Norrin polypeptide, or Wnt signaling agonist molecule comprises at least one modification as compared to an unmodified A, G, U or C ribonucleoside. In particular embodiments, the at least one modified nucleosides include N1-methylpseudouridine and/or 5-methylcytidine. In particular embodiments, the modified mRNA comprises a 5' terminal cap sequence followed by a sequence encoding the Wnt polypeptide, Norrin polypeptide, or Wnt signaling agonist molecule, following by a 3' tailing sequence, such as a polyA or a polyA-G sequence.

In particular embodiments, the polynucleotide is a vector, e.g., an expression vector, and the expression vector comprises a polynucleotide sequence encoding a Wnt polypeptide, Norrin polypeptide, or Wnt signaling agonist molecule described herein operably linked to a promoter sequence, e.g., a promoter sequence that drives expression of the polynucleotide in a cell. In certain embodiments, the vector is a viral vector, e.g., a virus comprising a polynucleotide comprising an expression cassette comprising a promoter operably linked to a DNA or RNA sequence encoding the Wnt polypeptide, Norrin polypeptide, or Wnt signaling agonist molecules. In particular embodiments, the expression cassette comprises 5' and/or 3' cellular or viral UTRs.

The present disclosure also includes functional fragments and variants of the polynucleotides described herein, including variants having at least 50%, at least 60%, at least 70%, at least 80%, at least 85%, at least 90%, at least 95%, at least 98% or at least 99% polynucleotide sequence identity to a polynucleotide described herein. Such variants may comprise one or more nucleotide or nucleoside modifications as compared to any of the sequences disclosed herein, e.g., one or more nucleotide deletion, insertion or substitution. In particular embodiments, the polynucleotides described herein are codon-optimized, e.g., to enhance expression of the encoded polypeptide in a host cell. In particular embodiments, polynucleotide variants comprise one or more modified nucleotide or nucleoside.

The present disclosure also includes cells comprising a polynucleotide or vector that encodes a Wnt polypeptide, Norrin polypeptide, or Wnt signaling agonist molecule described herein. In certain embodiments, the cell is a host cell, such as, e.g., an HEK293 cell that may be used to produce Wnt polypeptides, Norrin polypeptides, or Wnt signaling agonist molecules. In preparing the subject compositions, any host cells may be employed, including but not limited to, for example, mammalian cells (e.g. 293 cells), insect cells (e.g., SF9 cells), microorganisms and yeast. In certain embodiments, the cells are heterologous or autologous to a subject treated with a Wnt polypeptide, Norrin polypeptide, or Wnt signaling agonist molecule described herein. In particular embodiments, the cells were obtained from the subject and transduced with a viral vector described herein. In particular embodiments, the transduced cells are delivered to the subject for treatment. The present disclosure also includes pharmaceutical compositions comprising one or more Wnt polypeptide, Norrin polypeptide, or Wnt signaling agonist molecules, or one or more polynucleotides or vectors comprising sequences encoding a Wnt polypeptide, Norrin polypeptide, ord Wnt signaling agonist molecule.

Pharmaceutical Compositions

Pharmaceutical compositions comprising a tissue-specific Wnt signal enhancing molecule or antibody or antigen-binding fragment thereof described herein and one or more pharmaceutically acceptable diluent, carrier, or excipient are also disclosed. In particular embodiments, the pharmaceutical composition further comprises one or more Wnt polypeptides, Norrin polypeptides or Wnt signaling agonist molecules described herein.

In further embodiments, pharmaceutical compositions comprising a polynucleotide comprising a nucleic acid sequence encoding a tissue-specific Wnt signal enhancing molecule or antibody or antigen-binding fragment thereof described herein described herein and one or more pharmaceutically acceptable diluent, carrier, or excipient are also disclosed. In particular embodiments, the pharmaceutical composition further comprises one or more polynucleotides comprising a nucleic acid sequence encoding a Wnt polypeptides, Norrin polypeptides or Wnt signaling agonist molecules as described herein. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences. In certain embodiments, the nucleic acid sequence encoding the tissue-specific Wnt signal enhancing molecule and the nucleic acid sequence encoding the Wnt polypeptide, Norrin polypeptide or Wnt signaling agonist molecule are present in the same polynucleotide.

In further embodiments, pharmaceutical compositions comprising an expression vector, e.g., a viral vector, comprising a polynucleotide comprising a nucleic acid sequence encoding a tissue-specific Wnt signal enhancing molecule or antibody or antigen-binding fragment thereof described herein described herein and one or more pharmaceutically acceptable diluent, carrier, or excipient are also disclosed. In particular embodiments, the pharmaceutical composition further comprises an expression vector, e.g., a viral vector, comprising a polynucleotide comprising a nucleic acid sequence encoding a Wnt polypeptides, Norrin polypeptides or Wnt signaling agonist molecules as described herein. In certain embodiments, the nucleic acid sequence encoding the tissue-specific Wnt signal enhancing molecule and the nucleic acid sequence encoding the Wnt polypeptide, Norrin polypeptide or Wnt signaling agonist molecule are present in the same polynucleotide, e.g., expression cassette.

The present invention further contemplates a pharmaceutical composition comprising a cell comprising an expression vector comprising a polynucleotide comprising a promoter operatively linked to a nucleic acid encoding a tissue-specific Wnt signal enhancing molecule or antibody or antigen-binding fragment thereof described herein described herein and one or more pharmaceutically acceptable diluent, carrier, or excipient. In particular embodiments, the pharmaceutical composition further comprises a cell comprising an expression vector comprising a polynucleotide comprising a promoter operatively linked to a nucleic acid sequence encoding a Wnt polypeptide, a Norrin polypeptide or a Wnt signaling agonist molecules as described herein. In certain embodiments, the nucleic acid sequence encoding the tissue-specific Wnt signal enhancing molecule and the nucleic acid sequence encoding the Wnt polypeptide, Norrin polypeptide or Wnt signaling agonist molecule are present in the same polynucleotide, e.g., expression cassette and/or in the same cell. In particular embodiments, the cell is a heterologous cell or an autologous cell obtained from the subject to be treated. In particular embodiments, the cell is a stem cell, e.g., an adipose-derived stem cell or a hematopoietic stem cell.

The present disclosure contemplates pharmaceutical compositions comprising a first molecule for delivery of a tissue-specific Wnt signal enhancing molecule as a first active agent and a second molecule for delivery of a Wnt polypeptide, Norrin polypeptide or Wnt signaling agonist as a second active agent. The first and second molecule may be the same type of molecule or different types of molecules. For example, in certain embodiments, the first and second molecule may each be independently selected from the following types of molecules: polypeptides, small organic molecules, nucleic acids encoding the first or second active agent (optionally DNA or mRNA, optionally modified RNA), vectors comprising a nucleic acid sequence encoding the first or second active agent (optionally expression vectors or viral vectors), and cells comprising a nucleic acid sequence encoding the first or second active agent (optionally an expression cassette).

The subject molecules, alone or in combination, can be combined with pharmaceutically-acceptable carriers, diluents and reagents useful in preparing a formulation that is generally safe, non-toxic, and desirable, and includes excipients that are acceptable for mammalian, e.g., human or primate, use. Such excipients can be solid, liquid, semisolid, or, in the case of an aerosol composition, gaseous. Examples of such carriers or diluents include, but are not limited to, water, saline, Ringer's solutions, dextrose solution, and 5% human serum albumin. Supplementary active compounds can also be incorporated into the formulations. Solutions or suspensions used for the formulations can include a sterile diluent such as water for injection, saline solution, fixed oils, polyethylene glycols, glycerine, propylene glycol or other synthetic solvents; antibacterial compounds such as benzyl alcohol or methyl parabens; antioxidants such as ascorbic acid or sodium bisulfite; chelating compounds such as ethylenediaminetetraacetic acid (EDTA); buffers such as acetates, citrates or phosphates; detergents such as Tween 20 to prevent aggregation; and compounds for the adjustment of tonicity such as sodium chloride or dextrose. The pH can be adjusted with acids or bases, such as hydrochloric acid or sodium hydroxide. In particular embodiments, the pharmaceutical compositions are sterile.

Pharmaceutical compositions may further include sterile aqueous solutions or dispersions and sterile powders for the extemporaneous preparation of sterile injectable solutions or dispersion. For intravenous administration, suitable carriers include physiological saline, bacteriostatic water, or phosphate buffered saline (PBS). In some cases, the composition is sterile and should be fluid to the extent that easy syringability exists. In certain embodiments, it is stable under the conditions of manufacture and storage and is preserved against the contaminating action of microorganisms such as bacteria and fungi. The carrier can be, e.g., a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride in the composition. Prolonged absorption of the internal compositions can be brought about by including in the composition an agent which delays absorption, for example, aluminum monostearate and gelatin.

Sterile solutions can be prepared by incorporating the tissue-specific Wnt signal enhancing molecule in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

In one embodiment, the pharmaceutical compositions are prepared with carriers that will protect the fusion protein against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially. Liposomal suspensions can also be used as pharmaceutically acceptable carriers. These can be prepared according to methods known to those skilled in the art.

It may be advantageous to formulate the pharmaceutical compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The pharmaceutical compositions can be included in a container, pack, or dispenser, e.g. syringe, e.g. a prefilled syringe, together with instructions for administration.

The pharmaceutical compositions of the invention encompass any pharmaceutically acceptable salts, esters, or salts of such esters, or any other compound which, upon administration to an animal comprising a human, is capable of providing (directly or indirectly) the biologically active tissue-specific Wnt signal enhancing molecule.

The present invention includes pharmaceutically acceptable salts of the tissue-specific Wnt signal enhancing molecules described herein. The term "pharmaceutically acceptable salt" refers to physiologically and pharmaceutically acceptable salts of the compounds of the invention: i.e., salts that retain the desired biological activity of the parent compound and do not impart undesired toxicological effects thereto. A variety of pharmaceutically acceptable salts are known in the art and described, e.g., in "Remington's Pharmaceutical Sciences", 17th edition, Alfonso R. Gennaro (Ed.), Mark Publishing Company, Easton, Pa., USA, 1985 (and more recent editions thereof), in the "Encyclopaedia of Pharmaceutical Technology", 3rd edition, James Swarbrick (Ed.), Informa Healthcare USA (Inc.), N.Y., USA, 2007, and in J. Pharm. Sci. 66: 2 (1977). Also, for a review on suitable salts, see "Handbook of Pharmaceutical Salts: Properties, Selection, and Use" by Stahl and Wermuth (Wiley-VCH, 2002).

Pharmaceutically acceptable base addition salts are formed with metals or amines, such as alkali and alkaline earth metals or organic amines. Metals used as cations comprise sodium, potassium, magnesium, calcium, and the like. Amines comprise N—N'-dibenzylethylenediamine, chloroprocaine, choline, diethanolamine, dicyclohexylamine, ethylenediamine, N-methylglucamine, and procaine (see, for example, Berge et al., "Pharmaceutical Salts," J. Pharma Sci., 1977, 66, 119). The base addition salts of said acidic compounds are prepared by contacting the free acid form with a sufficient amount of the desired base to produce the salt in the conventional manner. The free acid form may be regenerated by contacting the salt form with an acid and isolating the free acid in the conventional manner. The free acid forms differ from their respective salt forms somewhat in certain physical properties such as solubility in polar solvents, but otherwise the salts are equivalent to their respective free acid for purposes of the present invention.

In some embodiments, the pharmaceutical composition provided herein comprise a therapeutically effective amount of a tissue-specific Wnt signal enhancing molecule described herein in admixture with a pharmaceutically acceptable carrier, diluent and/or excipient, for example saline, phosphate buffered saline, phosphate and amino acids, polymers, polyols, sugar, buffers, preservatives and other proteins. Exemplary amino acids, polymers and sugars and the like are octylphenoxy polyethoxy ethanol compounds, polyethylene glycol monostearate compounds, polyoxyethylene sorbitan fatty acid esters, sucrose, fructose, dextrose, maltose, glucose, mannitol, dextran, sorbitol, inositol, galactitol, xylitol, lactose, trehalose, bovine or human serum albumin, citrate, acetate, Ringer's and Hank's solutions, cysteine, arginine, carnitine, alanine, glycine, lysine, valine, leucine, polyvinylpyrrolidone, polyethylene and glycol. Preferably, this formulation is stable for at least six months at 4° C.

In some embodiments, the pharmaceutical composition provided herein comprises a buffer, such as phosphate buffered saline (PBS) or sodium phosphate/sodium sulfate, tris buffer, glycine buffer, sterile water and other buffers known to the ordinarily skilled artisan such as those described by Good et al. (1966) Biochemistry 5:467. The pH of the buffer may be in the range of 6.5 to 7.75, preferably 7 to 7.5, and most preferably 7.2 to 7.4.

Methods For Increasing Wnt Activity or Wnt Receptor Cell Surface Expression

Tissue-specific Wnt signal enhancing molecules, exemplified herein with respect to fusion proteins, may be used to increase Wnt signaling in a targeted tissue or cell type. In particular embodiments, the Wnt signaling is canonical Wnt signaling. Thus, in some aspects, the present invention provides a method for increasing or enhancing Wnt signaling in a target tissue or cell, comprising contacting the target tissue or cell with an effective amount of a tissue-specific Wnt signal enhancing molecule disclosed herein, wherein the molecule comprises a targeting module that binds to a cell surface receptor on the target tissue or cell in a tissue- or cell-specific manner. In some embodiments, contacting occurs in vitro, ex vivo, or in vivo, e.g., the subject tissue-specific Wnt signal enhancing molecule is administered or provided to a subject. In particular embodiments, the cell is a cultured cell, and the contacting occurs in vitro.

In certain embodiments, the method comprises further contacting the target tissue or cell with one or more Wnt polypeptides, Norrin polypeptides or Wnt signaling agonist molecules described herein. The present disclosure contemplates contacting a target tissue or cell with a first molecule for delivery of a tissue-specific Wnt signal enhancing molecule as a first active agent and a second molecule for delivery of a Wnt polypeptide, Norrin polypeptide or Wnt signaling agonist as a second active agent. The first and second molecule may be the same type of molecule or different types of molecules. For example, in certain embodiments, the first and second molecule may each be independently selected from the following types of molecules: polypeptides, small organic molecules, nucleic acids encoding the first or second active agent (optionally DNA or mRNA, optionally modified RNA), vectors comprising a nucleic acid sequence encoding the first or second active agent (optionally expression vectors or viral vectors), and cells comprising a nucleic acid sequence encoding the first or second active agent (optionally an expression cassette).

In related aspects, the present invention provides a method for increasing Wnt signaling in a target tissue or cell, comprising contacting the target tissue or cell with an effective amount of a polynucleotide comprising a nucleic acid sequence encoding a tissue-specific Wnt signal enhancing molecule disclosed herein, wherein the molecule comprises a targeting module that binds to a cell surface receptor on the target tissue or cell in a tissue- or cell-specific manner. In certain embodiments, the target tissue or cell is also contacted with a polynucleotide comprising a nucleic acid sequence that encodes a Wnt polypeptide, Norrin polypeptides or Wnt signaling agonist. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences. In certain embodiments, the nucleic acid sequence encoding the tissue-specific Wnt signal enhancing molecule and the nucleic acid sequence encoding the Wnt polypeptide, Norrin polypeptide or Wnt signaling agonist molecule are present in the same polynucleotide.

In related aspects, the present invention provides a method for increasing Wnt signaling in a target tissue or cell, comprising contacting the target tissue or cell with an effective amount of a vector comprising a nucleic acid sequence encoding a tissue-specific Wnt signal enhancing molecule of the present invention, wherein the molecule comprises a targeting module that binds to a cell surface receptor on the target tissue or cell in a tissue- or cell-specific manner. In certain embodiments, the target tissue or cell is also contacted with a vector comprising a nucleic acid sequence that encodes a Wnt polypeptide, Norrin polypeptides or Wnt signaling agonist. In certain embodiments, the vector is an expression vector, and may comprise a promoter operatively linked to the nucleic acid sequence. In particular embodiments, the vector is a viral vector. In certain embodiments, the nucleic acid sequence encoding the tissue-specific Wnt signal enhancing molecule and the nucleic acid sequence encoding the Wnt polypeptide, Norrin polypeptide or Wnt signaling agonist molecule are present in the same vector, e.g., in the same expression cassette.

In related aspects, the present invention provides a method for increasing Wnt signaling in a target tissue, comprising contacting the target tissue with an effective amount of a cell comprising a nucleic acid sequence encoding a tissue-specific Wnt signal enhancing molecule of the present invention, wherein the molecule comprises a targeting module that binds to a cell surface receptor on the target tissue or cell in a tissue- or cell-specific manner. In certain embodiments, the target tissue is also contacted with a cell comprising a nucleic acid sequence that encodes a Wnt polypeptide, Norrin polypeptides or Wnt signaling agonist. In certain embodiments, the nucleic acid sequence encoding the tissue-specific Wnt signal enhancing molecule and the nucleic acid sequence encoding the Wnt polypeptide, Norrin polypeptide or Wnt signaling agonist molecule are present in the same cell. In particular embodiments, the cell is a heterologous cell or an autologous cell obtained from the subject to be treated. In certain embodiments, the cell was transduced with a vector comprising an expression cassette encoding the tissue-specific Wnt signal enhancing molecule or the Wnt polypeptide, Norrin polypeptide or Wnt signaling agonist molecule. In particular embodiments, the cell is a stem cell, e.g., an adipose-derived stem cell or a hematopoietic stem cell.

Any of the methods described herein for increasing Wnt signalling may also be used to increase the number of Frizzled (Fz) receptors on the surface of targeted cells, e.g., liver tissue cells. In certain embodiments, the number of Fz receptors of the surface of the targeted cells is increase by at least 10%, at least 20%, at least 30%, at least 40%, at et least 50%, at least 60%, at least 70%, at least 80%, at least 90%, at least two-fold, at least five-fold, or at least 10-fold. In particular embodiments, the Fz receptors include one or more of human frizzled proteins Fz1, Fz2, Fz3, Fz4, Fz5, Fz6, Fz7, Fz8, Fz9, Fz10. For example, the disclosure provides a method for increasing Fz receptors on the surface of targeted cells, comprising contacting the cells with an effective amount of a tissue- or cell-specific Wnt signal enhancing molecule disclosed herein, wherein the molecule comprises a targeting module that binds to a cell surface receptor on the target tissue or cell in a tissue- or cell-specific manner. In particular embodiments, the cells are liver cells, and the targeting module binds ASGR1 or ASGR2. In certain embodiments, the targeting module comprises an antibody or antigen-binding fragment thereof disclosed herein. In some embodiments, contacting occurs in vitro, ex vivo, or in vivo, e.g., the tissue-specific Wnt signal enhancing molecule is administered or provided to a subject. In particular embodiments, the cell is a cultured cell, and the contacting occurs in vitro. In certain embodiments, the targeted cell or tissue is initially contacted with the Wnt signal enhancing molecule directly, whereas in other related embodiments, the cell is initially contacted with a polynucleotide encoding the Wnt signal enhancing molecule, e.g., an expression vector, whereby the cell takes up the polynucleotide and expresses the Wnt signal enhancing molecule. In certain embodiments, the method comprises further contacting the targeted tissue or cell with one or more Wnt polypeptides, Norrin polypeptides or Wnt signaling agonist molecules described herein.

Any of the methods described herein for increasing Wnt signalling may also be used to increase Ki-67 on targeted cells, e.g., liver tissue cells.

Methods For Treating Diseases and Disorders

Tissue-specific Wnt signal enhancing molecules, exemplified herein with respect to fusion proteins, may be used in to treat a disease, disorder or condition, for example, by increasing Wnt signaling in a targeted cell, tissue or organ. Thus, in some aspects, the present invention provides a method for treating a disease or condition in a subject in need thereof, e.g., a disease or disorder associated with reduced Wnt signaling, or for which increased Wnt signaling would provide a therapeutic benefit, comprising contacting the subject with an effective amount of a composition of the present disclosure. In particular embodiments, the composition is a pharmaceutical composition comprising any of: a tissue-specific Wnt signal enhancing molecule, e.g., a small molecule or a polypeptide; a polynucleotide comprising a nucleic acid sequence encoding a tissue-specific Wnt signal enhancing molecule, e.g., a DNA or mRNA, optionally a modified mRNA; a vector comprising a nucleic acid sequence encoding a tissue-specific Wnt signal enhancing molecule, e.g., an expression vector or viral vector; or a cell comprising a nucleic acid sequence encoding a tissue-specific Wnt signal enhancing molecule, e.g., a cell transduced with an expression vector or viral vector encoding a tissue-specific Wnt signal enhancing molecule. In particular embodiments, the disease or condition is a pathological disease or disorder, or an injury, e.g., an injury resulting from a wound. In certain embodiments, the wound may be the result of another therapeutic treatment. In certain embodiments, the disease or condition comprises impaired tissue repair, healing or regeneration, or would benefit from increased tissue repair, healing or regeneration. In some embodiments, contacting occurs in vivo, i.e., the subject composition is administered to a subject.

In certain embodiments, the method comprises further contacting the subject with a pharmaceutical composition comprising one or more Wnt polypeptides, Norrin polypeptides or Wnt signaling agonist molecules described herein. The present disclosure contemplates contacting a subject with a first molecule for delivery of a tissue-specific Wnt signal enhancing molecule as a first active agent and a second molecule for delivery of a Wnt polypeptide, Norrin polypeptide or Wnt signaling agonist as a second active agent. The first and second molecule may be the same type of molecule or different types of molecules. For example, in certain embodiments, the first and second molecule may each be independently selected from the following types of molecules: polypeptides, small organic molecules, nucleic acids encoding the first or second active agent (optionally DNA or mRNA, optionally modified RNA), vectors comprising a nucleic acid sequence encoding the first or second active agent (optionally expression vectors or viral vectors), and cells comprising a nucleic acid sequence encoding the first or second active agent (optionally an expression cassette).

In related aspects, the present invention provides a method for treating a disease or condition, e.g., a disease or disorder associated with reduced Wnt signaling, or for which increased Wnt signaling would provide a therapeutic benefit, comprising contacting a subject in need thereof with a pharmaceutical composition comprising an effective amount of a polynucleotide comprising a nucleic acid sequence encoding a tissue-specific Wnt signal enhancing molecule of the present invention, wherein the molecule comprises a targeting module that binds to a cell surface receptor on the target tissue or cell in a tissue- or cell-specific manner. In certain embodiments, the subject is also contacted with a pharmaceutical composition comprising an effective amount of a polynucleotide comprising a nucleic acid sequence that encodes a Wnt polypeptide, Norrin polypeptides or Wnt signaling agonist. In certain embodiments, the polynucleotides are DNA or mRNA, e.g., a modified mRNA. In particular embodiments, the polynucleotides are modified mRNAs further comprising a 5' cap sequence and/or a 3' tailing sequence, e.g., a polyA tail. In other embodiments, the polynucleotides are expression cassettes comprising a promoter operatively linked to the coding sequences. In certain embodiments, the nucleic acid sequence encoding the tissue-specific Wnt signal enhancing molecule and the nucleic acid sequence encoding the Wnt polypeptide, Norrin polypeptide or Wnt signaling agonist molecule are present in the same polynucleotide.

In related aspects, the present invention provides a method for treating a disease or condition, e.g., a disease or disorder associated with reduced Wnt signaling, or for which increased Wnt signaling would provide a therapeutic benefit, comprising contacting a subject in need thereof with a pharmaceutical composition comprising an effective amount of a vector comprising a nucleic acid sequence encoding a tissue-specific Wnt signal enhancing molecule of the present invention, wherein the molecule comprises a targeting module that binds to a cell surface receptor on the target tissue or cell in a tissue- or cell-specific manner. In certain embodiments, the subject is also contacted with a pharmaceutical composition comprising an effective amount of a vector comprising a nucleic acid sequence that encodes a Wnt polypeptide, Norrin polypeptides or Wnt signaling agonist. In certain embodiments, the vector is an expression vector, and may comprise a promoter operatively linked to the nucleic acid sequence. In particular embodiments, the vector is a viral vector. In certain embodiments, the nucleic acid sequence encoding the tissue-specific Wnt signal enhancing molecule and the nucleic acid sequence encoding the Wnt polypeptide, Norrin polypeptide or Wnt signaling agonist molecule are present in the same vector, e.g., in the same expression cassette.

In related aspects, the present invention provides a method for treating a disease or condition, e.g., a disease or disorder associated with reduced Wnt signaling, or for which increased Wnt signaling would provide a therapeutic benefit, comprising contacting a subject in need thereof with a pharmaceutical composition comprising an effective amount of a cell comprising a nucleic acid sequence encoding a tissue-specific Wnt signal enhancing molecule of the present invention, wherein the molecule comprises a targeting module that binds to a cell surface receptor on the target tissue or cell in a tissue- or cell-specific manner. In certain embodiments, the subject is also contacted with a cell comprising a nucleic acid sequence that encodes a Wnt polypeptide, Norrin polypeptides or Wnt signaling agonist. In certain embodiments, the nucleic acid sequence encoding the tissue-specific Wnt signal enhancing molecule and the nucleic acid sequence encoding the Wnt polypeptide, Norrin polypeptide or Wnt signaling agonist molecule are present in the same cell. In particular embodiments, the cell is a heterologous cell or an autologous cell obtained from the subject to be treated. In certain embodiments, the cell was transduced with a vector comprising an expression cassette encoding the tissue-specific Wnt signal enhancing molecule or the Wnt polypeptide, Norrin polypeptide or Wnt signaling agonist molecule. In particular embodiments, the cell is a stem cell, e.g., an adipose-derived stem cell or a hematopoietic stem cell.

Wnt signaling plays key roles in the developmental process and maintenance of stem cells. Reactivation of Wnt signals is associated with regeneration and repair of most tissues after injuries and diseases. Tissue-specific Wnt signal enhancing molecules may provide benefit of healing and tissue repair in response to injuries and diseases. Causes of tissue damage and loss include but are not limited to aging, degeneration, hereditary conditions, infection and inflammation, traumatic injuries, toxins/metabolic-induced toxicities, or other pathological conditions. Wnt signals and enhancers of Wnt signals have been shown to activate adult, tissue-resident stem cells. In some embodiments, the compounds of the invention are administered for use in treating diseased or damaged tissue, for use in tissue regeneration and for use in cell growth and proliferation, and/or for use in tissue engineering.

Human diseases associated with mutations of the Wnt pathway provide strong evidence for enhancement of Wnt signals in the treatment and prevention of diseases. Preclinical in vivo and in vitro studies provide additional evidence of involvement of Wnt signals in many disease conditions and further support utilization of tissue-specific Wnt signal enhancing molecules in various human diseases. For example, compositions of the present invention may be used to promote or increase bone growth or regeneration, bone grafting, healing of bone fractures, treatment of osteoporosis and osteoporotic fractures, spinal fusion, osseointegration of orthopedic devices, tendon-bone integration, tooth growth and regeneration, dental implantation, periodontal diseases, maxillofacial reconstruction, and osteonecrosis of the jaw. They may also be used in the treatment of alopecia; enhancing regeneration of sensory organs, e.g. treatment of hearing loss including regeneration of the inner and outer auditory hair cells, treatment of vestibular hypofunction, treatment of macular degeneration, treatment of retinopathies including vitreoretinopathy, diabetic retinopathy, or other diseases of retinal degeneration, Fuchs' dystrophy, other cornea disease, etc.; treatment of stroke, traumatic brain injury, Alzheimer's disease, multiple sclerosis and other conditions affecting the degeneration or integrity of the blood brain barrier; treatment of spinal cord injuries, other spinal cord diseases. The compositions of this invention may also be used in treatment of oral mucositis, intestinal mucositis, treatment of short bowel syndrome, inflammatory bowel diseases (IBDs), including but not limited to Crohn's Disease (CD) and ulcerative colitis (UC), in particular, CD and UC with fistula formation; other gastrointestinal disorders; treatment of metabolic syndrome; treatment of diabetes, treatment of pancreatitis, conditions where exocrine or endocrine pancreas tissues are damaged; conditions where enhanced epidermal regeneration is desired, e.g., epidermal wound healing, treatment of diabetic foot ulcers, syndromes involving tooth, nail, or dermal hypoplasia, etc., conditions where angiogenesis is beneficial; treatment of myocardial infarction, coronary artery disease, heart failure; enhanced growth of hematopoietic cells, e.g. enhancement of hematopoietic stem cell transplants from bone marrow, mobilized peripheral blood, treatment of immunodeficiencies, graft versus host diseases, etc.; treatment of acute kidney injuries, chronic kidney diseases; treatment of lung diseases, chronic obstructive pulmonary diseases (COPD), idiopathic pulmonary fibrosis, enhanced regeneration of lung tissues, in particular, proliferation and differentiation of pulmonary stems cells (e.g., AT2 and AT1 cells). The compositions of the present invention may also be used in enhanced regeneration of liver cells, e.g. liver regeneration, treatment of cirrhosis, enhancement of liver transplantations, treatment of acute liver failure, treatment of chronic liver diseases with hepatitis (A, B, or C) virus infection or post-antiviral drug therapies, alcoholic liver diseases, including alcoholic hepatitis, non-alcoholic liver diseases with steatosis or steatohepatitis, and the like. The compositions of this invention may treat diseases and disorders including, without limitation, conditions in which regenerative cell growth is desired.

Human genetics involving loss-of-function or gain-of-function mutations in Wnt signaling components show strong evidence supporting enhancing Wnt signals for bone growth. Conditions in which enhanced bone growth is desired may include, without limitation, fractures, grafts, ingrowth around prosthetic devices, osteoporosis, osteoporotic fractures, spinal fusion, osteonecrosis of the jaw, dental implantation, periodontal diseases, maxillofacial reconstruction, and the like. Tissue-specific Wnt signal enhancing molecules enhance and promote Wnt signals which are critical in promoting bone regeneration. Methods for regeneration of bone tissues benefit from administration of the compounds of the invention, which can be systemic or localized. In some embodiments, bone marrow cells are exposed to molecules of the invention, such that stem cells within that marrow become activated.

In some embodiments, bone regeneration is enhanced by contacting a responsive cell population, e.g. bone marrow, bone progenitor cells, bone stem cells, etc. with an effective dose of a molecule of the invention. Methods for regeneration of bone tissues benefit from administration of the compounds of the invention, which can be systemic or localized. In some such embodiments, the contacting is performed in vivo. In other such embodiments, the contacting is performed ex vivo. The molecule may be localized to the site of action, e.g. by loading onto a matrix, which is optionally biodegradable, and optionally provides for a sustained release of the active agent. Matrix carriers include, without limitation, absorbable collagen sponges, ceramics, hydrogels, polymeric microspheres, nanoparticles, bone cements, and the like.

Compositions comprising one or more of the molecules of the invention can be used for the in vivo treatment of skeletal tissue deficiencies. By "skeletal tissue deficiency", it is meant a deficiency in bone or other skeletal connective tissue at any site where it is desired to restore the bone or connective tissue, no matter how the deficiency originated, e.g. whether as a result of surgical intervention, removal of tumor, ulceration, implant, fracture, or other traumatic or degenerative conditions. The compositions of the present invention can be used as part of a regimen for restoring cartilage function to a connective tissue, for the repair of defects or lesions in cartilage tissue such as degenerative wear and arthritis, trauma to the tissue, displacement of torn meniscus, meniscectomy, a luxation of a joint by a torn ligament, malalignment of joints, bone fracture, or by hereditary disease.

The compositions of the invention may also be used for treatment of periodontal diseases. Periodontal diseases are a leading cause of tooth loss and are linked to multiple systemic conditions. In some embodiments, tooth or underlying bone regeneration is enhanced by contacting a responsive cell population. In some such embodiments, the contacting is performed in vivo. In other such embodiments, the contacting is performed ex vivo, with subsequent implantation of the activated stem or progenitor cells. The molecule may be localized to the site of action, e.g. by loading onto a matrix, which is optionally biodegradable, and optionally provides for a sustained release of the active agent. Matrix carriers include, without limitation, absorbable collagen sponges, ceramics, hydrogels, bone cements, polymeric microspheres, nanoparticles, and the like.

Studies have shown that biology of Wnt signaling and R-spondins are capable of promoting sensory hair cell regeneration in the inner ear following injuries, aging, or degeneration. Loss of sensory hair cells in the inner ear involved in hearing loss or vestibular hypofunction may also benefit from the compositions of the invention. In the inner ear, the auditory organ houses mechanosensitive hair cells required for translating sound vibration to electric impulses. The vestibular organs, comprised of the semicircular canals (SSCs), the utricle, and the saccule, also contain sensory hair cells in order to detect head position and motion. Compositions of the present invention can be used, for example, in an infusion; in a matrix or other depot system; or other topical application to the ear for enhancement of auditory regeneration.

The compositions of this invention may also be used in regeneration of retinal tissue. In the adult mammalian retina, Muller glia cells are capable of regenerating retinal cells, including photoreceptors, for example after neurotoxic injury in vivo. Wnt signaling and enhancers of Wnt signals can promote proliferation of Muller glia-derived retinal progenitors after damage or during degeneration. The compositions of the invention may also be used in the regeneration of tissues and other cell types in the eye. For examples age-related macular degeneration (AMD), other retina degenerative diseases, cornea diseases, Fuchs' dystrophy, vitreoretinopathy, hereditary diseases, etc. can benefit from the compositions of the present inventions. AMD is characterized by progressively decreased central vision and visual acuity. Fuchs' dystrophy is characterized by progressive loss of cornea endothelial cells. Wnt signal and enhancing of Wnt signal can promote regeneration of cornea endothelium, retina epithelium, etc. in the eye tissue. In other embodiments, compositions of the present invention can be used, for example, in an infusion; in a matrix or other depot system; or other topical application to the eye for retinal regeneration and treatment of macular degeneration.

Specific populations of proliferating cells for homeostatic renewal of hepatocytes have been identified through lineage tracing studies, for example Axing-positive cells in pericentral region. Lineage tracing studies also identified additional potential liver progenitor cells, including but not limited to Lgr-positive cells. The self-renewing liver cells and other populations of potential progenitor cells, including Lgr5-positive and Axing-positive cells, are identified to be capable of regeneration responding to Wnt signals and/or R-spondins following injuries. Numerous preclinical models of acute liver injury and failure and chronic liver diseases showed recovery and regeneration of hepatocytes benefit from enhancing Wnt signals. In certain embodiments, the compositions of this invention may be used in treatment of, e.g., acute liver failure (of all causes), acute alcoholic liver injuries, chronic liver diseases with hepatitis C or B virus infection or post-antiviral drug therapies, chronic alcoholic liver diseases, non-alcoholic fatty liver diseases (NAFLD) (fatty liver), non-alcoholic steatohepatitis (NASH), cirrhosis, severe chronic liver diseases of all causes, acute liver failure of all causes, acute liver failure drug-induced, alcoholic liver diseases, chronic liver failure (of all causes), liver fibrosis of all causes, portal hypertension, chronic liver insufficiency of all causes, alcoholic hepatitis, hepatitis C virus-induced liver diseases (HCV), hepatitis B virus-induced liver diseases (HBV), other viral hepatitis (e.g., hepatitis A virus-induced liver diseases (HAV) and hepatitis D virus-induced liver diseases (HDV)), primary biliary cirrhosis, autoimmune hepatitis, livery surgery, liver injury, liver transplantation, "small for size" syndrome in liver surgery and transplantation, congenital liver disease and disorders, any other liver disorder or defect resulting from genetic diseases, degeneration, aging, drugs, or injuries. They may also be used to enhance regeneration of liver cells, in vivo or in vitro. Methods for regeneration of liver tissue benefit from administration of the compounds of the invention, which can be systemic or localized. These include, but are not limited to, methods of systemic administration and methods of localized administration, e.g., by injection into the liver tissue, by injection into veins or blood vessels leading into the liver, by implantation of a sustained release formulation, and the like.

The compositions of the present invention may be used to treat end stage liver disease (ESLD). ESLD or chronic liver failure is often the result of severe liver cirrhosis and the resultant liver fibrosis. ESLD is manifested by the development of ascites, variceal hemorrhage, hepatic encephalopathy and/or liver function impairment (e.g., decompensated liver disease). Common diseases or disorders associated with ESLD include: alcoholic hepatitis, chronic hepatitis C infection, chronic hepatitis B infection, chronic hepatitis D infection, non-alcoholic fatty liver disease (NAFLD), including non-alcoholic steatoheptitis (NASH), and inherited diseases such as cystic fibrosis, alpha-1 anti-trypsin deficiency, hemochromatosis, Wilson disease, galactosemia, and glycogen storage disease. Prolonged exposure to drugs, toxic chemicals, parasitic infections, and repeated heart failures with liver congestion can also result in ESLD.

Wnt signals play an important role in regeneration of various epithelial tissues. Various epidermal conditions benefit from treatment with the compounds of the present invention. Mucositis occurs when there is a breakdown of the rapidly divided epithelial cells lining the gastro-intestinal tract, leaving the mucosal tissue open to ulceration and infection. The part of the epithelial lining that covers the mouth, called the oral mucosa, is one of the most sensitive parts of the body and is particularly vulnerable to chemotherapy and radiation. Oral mucositis is probably the most common, debilitating complication of cancer treatments, particularly chemotherapy and radiation. In addition, the compositions of the invention may also benefit treatment of intestinal mucositis, short bowel syndrome, inflammatory bowel diseases (IBD), or other gastrointestinal disorders. Other epidermal conditions include epidermal wound healing, diabetic foot ulcers, syndromes involving tooth, nail, or dermal hypoplasia, and the like. Molecules of the present invention may be used in all these conditions, where regenerative cells are contacted with compounds of the invention. Methods for regeneration of epithelial tissues benefit from administration of the compounds of the invention, which can be systemic or localized. Contacting can be, for example, topical, including intradermal, subdermal, in a gel, lotion, cream etc. applied at targeted site, etc.

In addition to skin and gastrointestinal tract, Wnt signals and enhancement and promotion of Wnt signals also play an important role in repair and regeneration of tissues including pancreas, kidney, and lung in preclinical models. Tissue-specific Wnt signal enhancing molecules may benefit various disease conditions involving exocrine and endocrine pancreas, kidney, or lung. The compositions of the invention may be used in treatment of metabolic syndrome; treatment of diabetes, treatment of acute or chronic pancreatitis, exocrine pancreatic insufficiency, treatment of acute kidney injuries, chronic kidney diseases, treatment of lung diseases, including but not limited to chronic obstructive pulmonary diseases (COPD), idiopathic pulmonary fibrosis, other conditions that cause loss of lung epithelial tissues. Methods for regeneration of these tissues benefit from administration of the compounds of the invention, which can be systemic or localized.

Epidermal Wnt signaling, in coordination with signaling via other development factors, is critical for adult hair follicle regeneration. Hair loss is a common problem, and androgenetic alopecia, often called male pattern baldness, is the most common form of hair loss in men. In some embodiments, hair follicle regeneration is enhanced by contacting a responsive cell population with a molecule of the present invention. In some such embodiments, the contacting is performed in vivo. In other such embodiments, the contacting is performed ex vivo. The molecule may be localized to the site of action, e.g. topical lotions, gels, creams and the like.

Stroke, traumatic brain injury, Alzheimer's disease, multiple sclerosis and other conditions affecting the blood brain barrier (BBB) may be treated with tissue-specific Wnt signal enhancing molecules of the invention. Angiogenesis is critical to ensure the supply of oxygen and nutrients to many tissues throughout the body, and is especially important for the CNS as the neural tissue is extremely sensitive to hypoxia and ischemia. CNS endothelial cells which form the BBB differ from endothelial cells in non-neural tissue, in that they are highly polarized cells held together by tight junctions and express specific transporters. Wnt signaling regulates CNS vessel formation and/or function. Conditions in which the BBB is compromised can benefit from administration of the compounds of the invention, which can be systemic or localized e.g. by direct injection, intrathecal administration, implantation of sustained release formulations, and the like. In addition, Wnt signal is actively involved in neurogenesis and plays a role of neuroprotection following injury. The compositions of the present invention may also be used in treatment of spinal cord injuries, other spinal cord diseases, stroke, traumatic brain injuries, etc.

Wnt signals also play a role in angiogenesis. Tissue-specific Wnt signal enhancing molecules may benefit conditions where angiogenesis is beneficial, treatment of myocardial infarction, coronary artery disease, heart failure, etc., and conditions from hereditary diseases. Methods for regeneration of these tissues benefit from administration of the compounds of the invention, which can be systemic or localized.

In certain embodiments, methods of the present invention promote tissue regeneration, e.g., in a tissue subjected to damage or tissue or cell reduction or loss. The loss or damage can be anything which causes the cell number to diminish, including diseases or injuries. For example, an accident, an autoimmune disorder, a therapeutic side-effect or a disease state could constitute trauma. Tissue regeneration increases the cell number within the tissue and preferably enables connections between cells of the tissue to be re-established, and more preferably the functionality of the tissue to be regained.

In particular embodiments, a composition is administered parenterally, e.g., intravenously, orally, rectally, or by injection. In some embodiments, it is administered locally, e.g., topically or intramuscularly. In some embodiments, a composition is administered to target tissues, e.g., to bone, joints, ear tissue, eye tissue, gastrointestinal tract, skin, a wound site or spinal cord. Methods of the invention may be practiced in vivo or ex vivo. In some embodiments, the contacting of a target cell or tissue with a tissue-specific Wnt signal enhancing molecule is performed ex vivo, with subsequent implantation of the cells or tissues, e.g., activated stem or progenitor cells, into the subject. The skilled artisan can determine an appropriate site of and route of administration based on the disease or disorder being treated.

The dose and dosage regimen may depend upon a variety of factors readily determined by a physician, such as the nature of the disease or disorder, the characteristics of the subject, and the subject's history. In particular embodiments, the amount of tissue-specific Wnt signal enhancing molecule, e.g., fusion protein, administered or provided to the subject is in the range of about 0.01 mg/kg to about 50 mg/kg, 0.1 mg/kg to about 500 mg/kg, or about 0.1 mg/kg to about 50 mg/kg of the subject's body weight.

In certain embodiments, the subject may be any mammal, e.g. human, rodent (e.g. mice, rats, gerbils), rabbit, feline, canine, goat, ovine, pig, equine, bovine, or primate.

In some embodiments, the subject method results in a therapeutic benefit, e.g., preventing the development of a disorder, halting the progression of a disorder, reversing the progression of a disorder, etc. In some embodiments, the subject method comprises the step of detecting that a therapeutic benefit has been achieved. The ordinarily skilled artisan will appreciate that such measures of therapeutic efficacy will be applicable to the particular disease being modified, and will recognize the appropriate detection methods to use to measure therapeutic efficacy.

In certain embodiments, the disclosure provides a method for treating or preventing a disease or disorder associated with reduced Wnt signaling or that would benefit from increased Wnt signaling activity in bone tissue, such as, for example, any of the conditions dsclosed herein wherein bone growth is desirable, comprising providing to a subject in need thereof a pharmaceutical composition comprising a Wnt signal enhancing molecule comprising a targeting module that binds bone tissue, e.g., a targeting module that specifically binds to PTH1R, wherein the Wnt signal enhancing molecule increases or enhances Wnt signaling in the subject's bone tissue. In certain embodiments, the pharmaceutical composition is administered orally or systemically, e.g., parenterally. In particular embodiments, the Wnt signal enhancing molecule comprises an action module comprising an R-spondin Furin domain 1 or a fragment or variant thereof and, optionally, a mutated Furin domain 2 or a fragment or variant thereof.

In certain embodiments, the disclosure provides a method for treating or preventing a disease or disorder associated with reduced Wnt signaling or that would benefit from increased Wnt signaling activity in liver tissue, such as, for example, any of the diseases or disorders disclosed herein that would benefit from liver regeneration, comprising providing to a subject in need thereof a pharmaceutical composition comprising a Wnt signal enhancing molecule comprising a targeting module that binds liver tissue, e.g., a targeting module that specifically binds to ASGR1, ASGR2, TFR2 or SLC10A1, wherein the Wnt signal enhancing molecule increases or enhances Wnt signaling in the subject's liver tissue. In certain embodiments, the pharmaceutical composition is administered orally or systemically, e.g., parenterally. In particular embodiments, the Wnt signal enhancing molecule comprises an action module comprising an R-spondin Furin domain 1 or a fragment or variant thereof and, optionally, a mutated Furin domain 2 or a fragment or variant thereof.

In certain embodiments, the disclosure provides a method for treating or preventing a disease or disorder associated with reduced Wnt signaling or that would benefit from increased Wnt signaling activity in oral mucosa tissue, such as, for example, oral mucositis, comprising providing to a subject in need thereof a pharmaceutical composition comprising a Wnt signal enhancing molecule comprising a targeting module that binds oral mucosa tissue, e.g., a targeting module that specifically binds to LYPD3 or DSG3, wherein the Wnt signal enhancing molecule increases or enhances Wnt signaling in the subject's oral mucosa tissue. In certain embodiments, the pharmaceutical composition is administered orally or systemically, e.g., parenterally. In particular embodiments, the Wnt signal enhancing molecule comprises an action module comprising an R-spondin Furin domain 1 or a fragment or variant thereof and, optionally, a mutated Furin domain 2 or a fragment or variant thereof.

All of the above U.S. patents, U.S. patent application publications, U.S. patent applications, foreign patents, foreign patent applications and non-patent publications referred to in this specification and/or listed in the Application Data Sheet, are incorporated herein by reference, in their entirety.

From the foregoing it will be appreciated that, although specific embodiments of the invention have been described herein for purposes of illustration, various modifications may be made without deviating from the spirit and scope of the invention. Accordingly, the invention is not limited except as by the appended claims.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Centigrade, and pressure is at or near atmospheric.

General methods in molecular biology, cell biology and biochemistry can be found in such standard textbooks as "Molecular Cloning: A Laboratory Manual, 3rd Ed." (Sambrook et al., Harbor Laboratory Press 2001); "Short Protocols in Molecular Biology, 4th Ed." (Ausubel et al. eds., John Wiley & Sons 1999); "Protein Methods" (Bollag et al., John Wiley & Sons 1996); "Nonviral Vectors for Gene Therapy" (Wagner et al. eds., Academic Press 1999); "Viral Vectors" (Kaplift & Loewy eds., Academic Press 1995); "Immunology Methods Manual" (I. Lefkovits ed., Academic Press 1997); and "Cell and Tissue Culture: Laboratory Procedures in Biotechnology" (Doyle & Griffiths, John Wiley & Sons 1998), the disclosures of which are incorporated herein by reference. Reagents, cloning vectors, and kits for genetic manipulation referred to in this disclosure are available from commercial vendors such as BioRad, Stratagene, Invitrogen, Sigma-Aldrich, and ClonTech.

Materials and methods employed in the following Examples include the following.

Published ASGR1 Binders: The prototypical anti-ASGR1 binder (R0-01) and several others (R0-02, -03, and -04) were selected from PCT Patent Application Publication No. WO2014/023709. The anti-TFR1 sequence was selected from PCT Patent Application Publication No. WO2016/081640. The anti-LYPD3 sequence was selected from PCT Patent Application Publication No. WO2017/0158775. The anti-DSG3 sequence was selected from PCT Patent Application Publication No. WO2010/092457. ZNRF3 binder SC-01 and SC-02 were selected from PCT Patent Application Publication No. WO2015/164392. RNF43 binder NV-01 was selected from PCT Patent Application Publication No. WO 2013/054307.

Protein production: All recombinant proteins were produced in Expi293F cells (Thermo Fisher Scientific) by transient transfection unless otherwise specified. All scFv-containing fusions contain a FLAG-His tag and were first purified using cOmplete his-tag purification resin (Sigma-Aldrich) following vendor recommended procedures. All IgG-based and Fc-containing constructs were first purified with Protein-A resin and eluted with 0.1 M glycine pH 3.5. All proteins were then polished by a size exclusion column in HBS buffer (10 mM HEPES pH 7.2, 150 mM NaCl). Proteins were supplemented with glycerol to 10% for long term storage at -80° C. For in vitro receptor binding analyses, extracellular domains of human RNF3 (Q44-D198) and ZNRF3 (K56-M219) and ASGR1 (Q62-L291) were expressed with a His-Avi tag at the N-terminus, and mouse ASGR1 (Q61-N284) was expressed with a His-Avi tag at the C-terminus. They were purified by His-tag resin, biotinylated as described (Janda et al., 2017; Nature 545:234), then further purified by size exclusion chromatography. For affinity measurement Fab version of the ASGR1 binder was made with a (His)6 tag at the C-terminus of human IgG1 CH1 domain following a 5-mer linker (GSGSG), and purified by His-tag resin followed by size exclusion chromatography. All proteins tested were examined by SDS-polyacrylamide electrophoresis and estimated to be at least 90% pure.

SuperTop Flash (STF) assay: Wnt signaling activity was measured using cell lines containing a luciferase gene controlled by a Wnt-responsive promoter (Super Top Flash reporter assay, STF) as reported (Janda et al., 2017; Nature 545:234). In brief, cells were seeded at a density of 10,000 per well in 96-well plates 24 hr prior to treatment, then treated by RSPO or mimetic proteins overnight either alone or together with 30% Wnt3a-conditioned media. Wnt3a conditioned media was prepared from ATCC-CRL-2647 Wnt3a secreting L cells following vendor recommended conditions. Cells were lysed with Luciferase Cell Culture Lysis Reagent (Promega) and activity was measured with Luciferase Assay System (Promega) using vendor suggested procedures. Data were plotted as average –/+ standard deviation of triplicates and fitted by non-linear regression using Prism (GraphPad Software). For over expression of exogenous receptors, cells were transiently transfected with plasmids containing receptors of interest under eukaryotic expression promoters (ASGR1 was clone OHU03658D from GenScript, ASGR2 was in-house cloned isoform d/NP_001188281.1, and TFRC was clone HG11020-UT from SinoBiologicals), then split into 96-well plates (20,000 cells per well) for STF assay 24 hr post transfection.

Affinity measurement: Binding kinetics of the RSPO-derived proteins to LGR5, RNF43, or ZNRF3, and binding of the anti-ASGR Fabs to human and/or mouse ASGR1 were determined by bio-layer interferometry (BLI) using Octet Red 96 (PALL ForteBio, Fremont, CA) instruments at 30° C., 1000 rpm with either streptavidin (SA) or anti-hIgG Fc capture (AHC) biosensors. Biotinylated extracellular domain (ECD) of RNF43 or ZNRF3 or ASGR1 and Fc portion of human IgG1-fused LGR5-ECD (R&D systems) were diluted to 50 nM in the running buffer (PBS, 0.05% Tween-20, 0.5% BSA, pH 7.2) captured to the SA biosensor and the AHC biosensor, respectively, until coupling level reached ~1.0 nm. Following capture of ECDs of RNF43, ZNRF3 or LGR5, the biosensors were dipped into wells containing the relevant test molecules at 7 different concentrations in running buffer plus a well with only running buffer as a reference channel. $K_D$ was determined by steady-state analysis based on the average responses between 140 to 145 seconds of association phase, for binding to LGR5, RNF43, and ZNRF3. For the binding to ASGR, $K_D$ was determined by curve model fitting using the Octet® Red data analysis software (Fortebio)

Cell flow cytometry: HEK293 cells transiently transfected with a plasmid overexpressing ZNRF3 (GenScript OHu22977), alone or together with ASGR1, and were treated for 24 hours with RSPO derivative molecules at 10 nM final concentration with or without 10% Wnt3a conditioned media. Cells were dissociated using Gibco enzyme-free dissociation buffer, washed, and resuspended in FACS buffer (1×PBS with 1% BSA with 0.02% sodium azide). Cells were incubated with 1 nM 18R5 IgG (pan-frizzled) for 1 hour. After washing, the cells were incubated with goat anti-human IgG Alexa Fluor 647 (Invitrogen) for 40 minutes. Cells were washed with FACS buffer and subjected to multi-channel analysis using a BD Accuri C6 Plus Flow Cytometer. Data were processed with FlowJo software and fluorescence signals were displayed in histogram plots.

Western blot analysis of cellular proteins: Cells were lysed with RIPA buffer (50 mM Tris-HCl pH7.4, 150 mM NaCl, 1% IGEPAL CA630, 0.5% sodium deoxycholate, 0.1% SDS and 1 mM EDTA) supplemented with protease and phosphatase inhibitors. Cell lystes were spun at 15,000 rpm at 4° C. for 5 min and supernatants were resolved by SDS-PAGE, transferred to nitrocellulose membranes and probed with primary antibody followed by HRP-conjugated secondary antibody and ECL film detection. The anti-LRP6, anti-phospho-LRP6 (Ser 1490) and anti-DLV2 primary antibodies were from Cell Signaling Technology. Anti-α tubulin antibody was from Sigma-Aldrich.

Semi-quantitative PCR analysis of gene expression: RNA from human cell cultures (HEK293, Huh-7 and A431) were extracted using the Qiagen RNeasy Micro Kit (Qiagen, 74004). cDNA was produced using the SuperScript™ VILO™ cDNA Synthesis Kit (ThermoFisher, 11754050). Human ASGR1, ASGR2 and TFRC expression were measured by using TaqMan® Fast Advanced Master Mix (ThermoFisher, 4444963) and the Hs01005019_m1ASGR1, the Hs00154160_m1ASGR2 and the Hs00951083_m1TFRC probes (ThermoFisher, 4331182). Values were normalized to expression of constitutive Actin B gene using the Hs01060665_m1probe (ThermoFisher, 4331182). RNA from mouse tissues (liver and small intestine samples) was extracted using the MagMAX™ mirVana™ Total RNA Isolation Kit (ThermoFisher, A27828). cDNA was produced using the high-Capacity cDNA Reverse Transcription Kit (ThermoFisher, 43-688-14) or the SuperScript™ IV VILO™ Master Mix (ThermoFisher, Cat. No. 11756050). Mouse Axing and Ki67 mRNA expression were measured by using TaqMan® Fast Advanced Master Mix (ThermoFisher, 4444963) and the Mm00443610_m1Axing, Mm01278617_m1Ki67, Mm01300555_g1 wnt1, Mm00470018_m1 wnt2, Mm00437336_m1 wnt3, Mm01194003_m1 wnt4, Mm00437347_m1 wnt5a, Mm01183986_m1 wnt5b, Mm00437353_m1 wnt6, Mm00437356_m1 wnt7a, Mm01301717_m1 wnt7b, Mm01157914_g1 wnt8a, Mm00457102_m1 wnt9b, Mm00442104_m1 wnt10b, Mm00437327_1 wnt11, Mm00446420_m1 wnt16, Mm00507077_m1 rspo1, Mm00555790_m1 rspo2, Mm01188251_m1 rspo3, and Mm00615419_m1 rspo4 probes (ThermoFisher, 4331182). Values were normalized to expression of constitutive Actin B gene using the Mm02619580_g1 probe (ThermoFisher, 4351368).

Animal studies: Six-week old C57Bl/6J male mice were obtained from Jackson Laboratories (Bar Harbor, ME, USA) and were group-housed. All animal experimentation was in accordance with the criteria of the "Guide for the Care and Use of Laboratory Animals" prepared by the National Academy of Sciences. Protocols for animal experimentation were approved by the Surrozen Institutional Animal Care and Use Committee. Mice were acclimatized a minimum of two days prior to initiating experiments. Mice had unlimited access to purified, laboratory-grade acidified water and were fed ad libitum (2018 Teklad global 18% protein rodent diet). Mice were kept on a 12/12-hour light/dark cycle in a 30% to 70% humidity environment and room temperature ranging from 20° C. to 26° C.

In cases where the mice were humanized for human ASGR gene expression, each mouse was dosed with 1×10$^{11}$ ssAAV8-CAG-hASGR1 genome copies (Vector Biolabs, Malvern, PA) intravenously on day 0. On day 7, mice were injected intraperitoneally (i.p.) with αGFP, Fc-RSPO2-WT, αGFP-RSPO2-RA or αASGR1-RSPO2-RA. At indicated times after protein dosing, mice were anesthetized with isoflurane and blood was removed by cardiac puncture. A portion of the left liver lobe and duodenum were collected for analysis.

Example 1

Characterization of Tissue-Specific Wnt Signaling Enhancing Molecules

To create a tissue-specific RSPO-like Wnt signaling enhancer molecule, the asialoglycoprotein receptor (ASGR) was targeted. ASGR is a hetero-oligomer composed of two polypeptides, ASGR1 and ASGR2, that are predominantly expressed on hepatocytes and goes through rapid endocytosis. An ASGR1 antibody (e.g., RO-01) was converted into the scFv format and fused it to the N-terminus of different RSPO2 variants to create αASGR1-RSPO2-WT, αASGR1-RSPO2-RA, or αASGR1-RSPO2-5mut (SEQ ID NOs: 11-16, FIG. 1B, right panel). In this design, the antibody part of the fusion functions as a "targeting module" guiding the cell/tissue specificity, while the RSPO2 component functions as an "action module" interacting with the E3 ligases (FIG. 1B). To abolish LGR binding, point mutations were introduced into two highly conserved hydrophobic residues within the Fu2 domain of RSPO2 that are reported to be critical for binding to LGR proteins, F105R and F109A, were introduced (FIG. 1B, named αASGR1-RSPO2-RA). To verify the involvement of Fu1 domain in E3 ligase interaction, additional point mutations in Fu1 domain reported to be critical for this interaction (R65A/R69A/Q70A) were also added (FIG. 1B, αASGR1-RSPO2-5mut which contains all 5 mutations, F105R/F109A/R65A/R69A/Q70A in both Fu1 and Fu2). As a negative control for the targeting module, a scFv antibody against green fluorescent protein (GFP) was fused to the same human Rspo2 fragments and mutants (α-GFP-Rspo2-WT, α-GFP-Rspo2-RA, and α-GFP-Rspo2-5mut; SEQ ID NOs: 5-10, FIG. 1B; left panel).

Figure 1C:
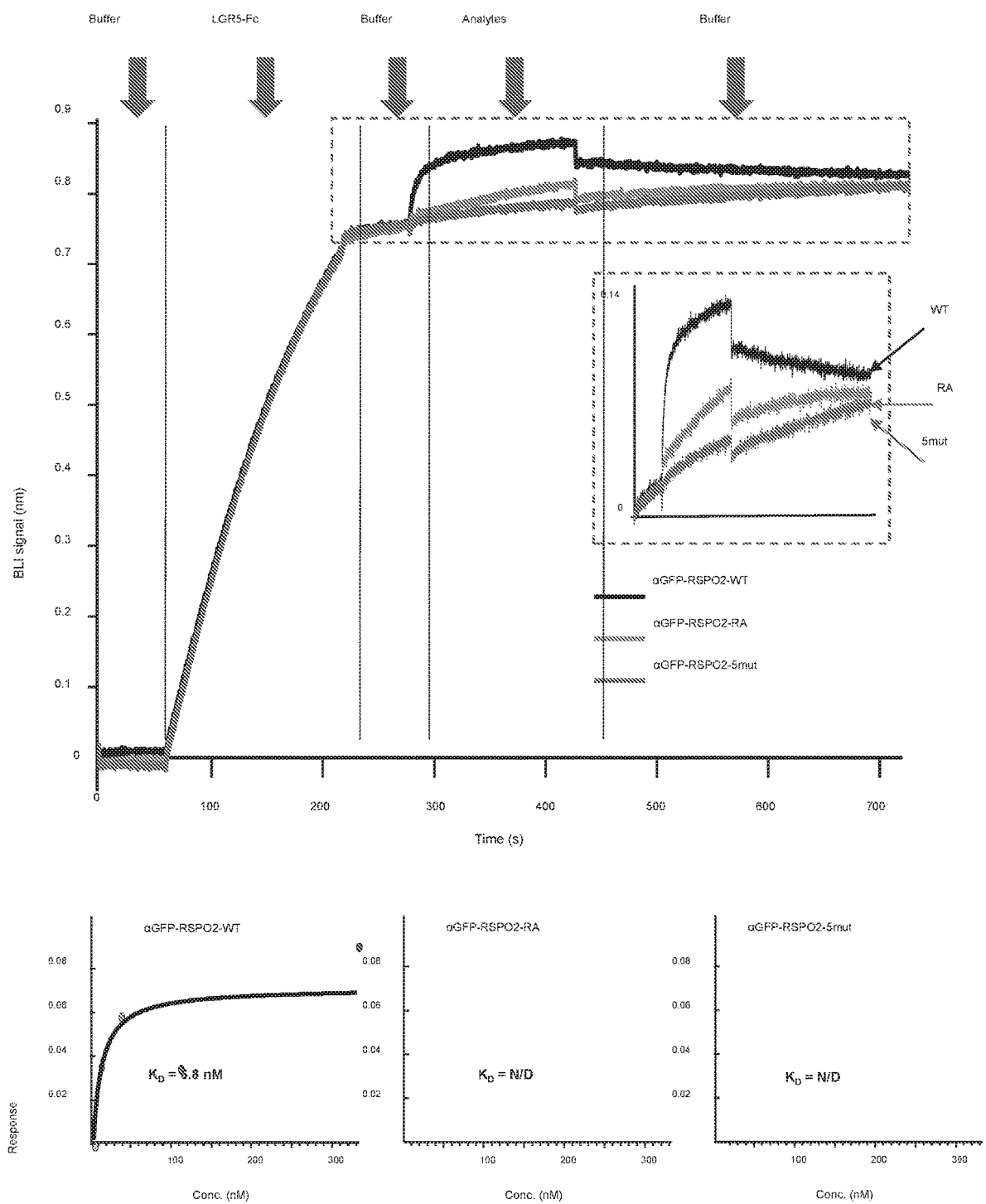
Figure 1C:
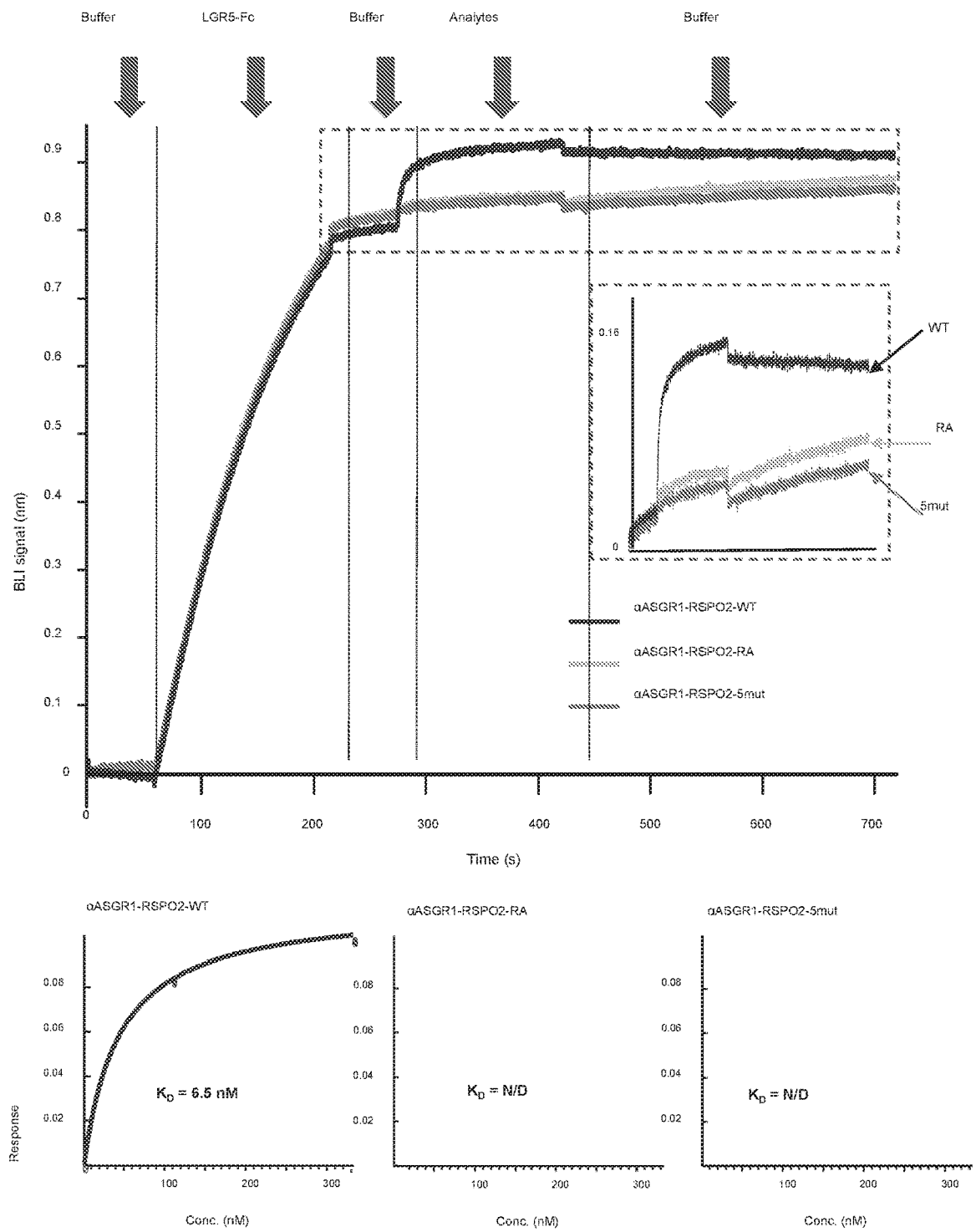

The impact of the Fu1 and Fu2 mutations on LGR and E3 ligase binding were verified using bio-layer interferometry on an Octet system. The binding of wild type (αGFP-RSPO2-WT), or mutants (αGFP-RSPO2-RA or αGFP-RSPO2-5mut) to recombinant LGR5 protein were measured, and the binding of the wild type was observed but not the two Fu2 mutant RSPO variants (FIG. 1C). The effect of the Fu2 mutations are specific to LGR interaction as the binding of αGFP-RSPO2-RA to E3 ligases, ZNRF3 and RNF3, were not affected (FIG. 1D), while the αGFP-RSPO2-5mut containing mutations in the Fu1 domain additionally affected interaction with E3 ligases (FIG. 1D).

Figure 2C:
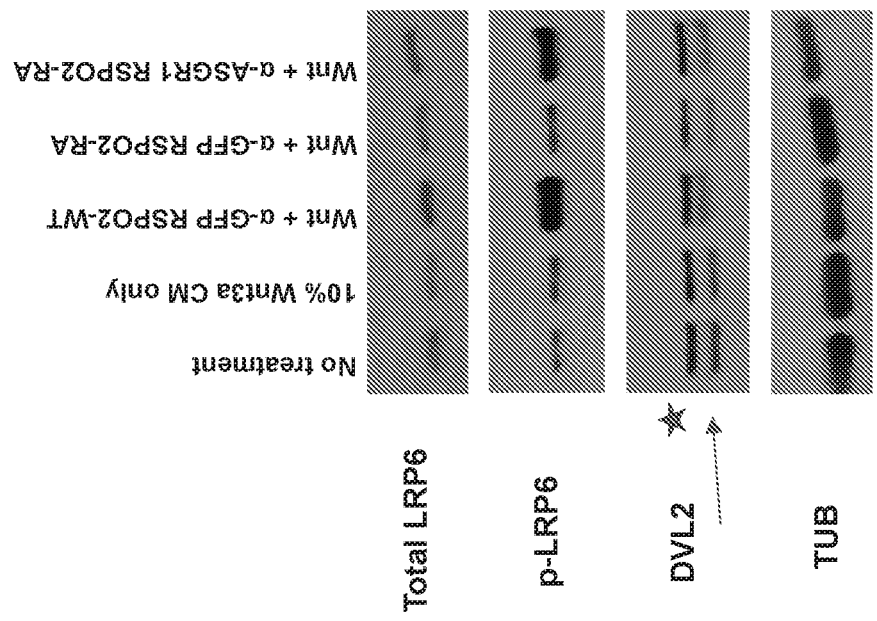
FIGS. 2A-2C. In vitro activity of hepatocyte-specific Wnt signaling enhancer molecules.

The impact of the Fu1 and Fu2 mutations on the ability of RSPO2 to enhance Wnt signaling was tested in HEK293 and Huh-7 Wnt responsive STF cells. As shown in FIG. 2B, right panels, in the absent of any added Wnt, none of the RSPO2 proteins activated Wnt signaling. In the presence of Wnt3a conditioned media (CM), αGFP-RSPO2-WT enhanced Wnt3a activity in a dose responsive matter, however, mutations in either Fu1 (αGFP-RSPO2-RA) or Fu1+Fu2 (αGFP-RSPO2-5mut) were completely inactive, consistent with the expectation that RSPO2 activity depends on the ability to engage both E3 ligases and LGR proteins.

Figure 1D:
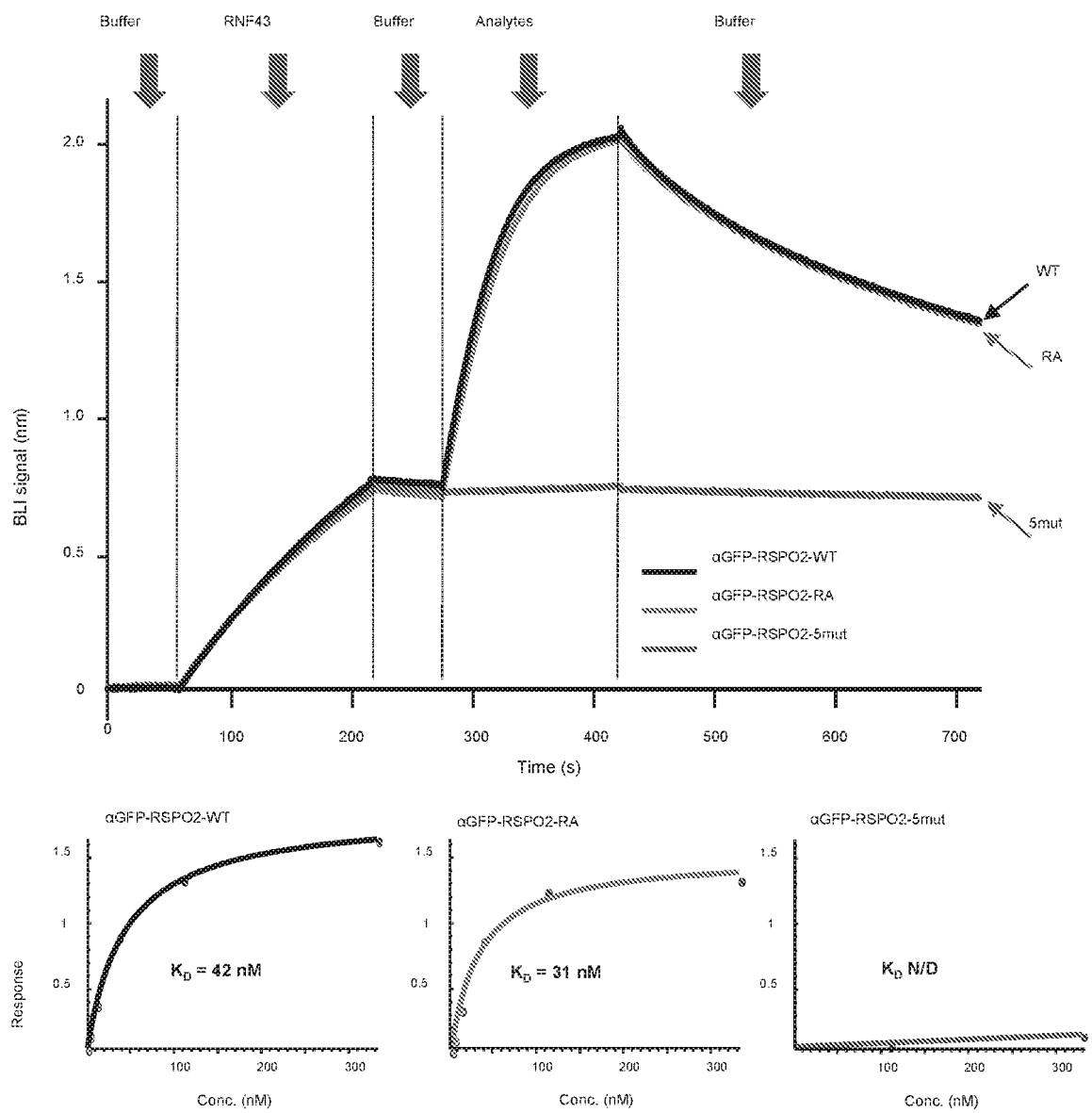
Figure 1D:
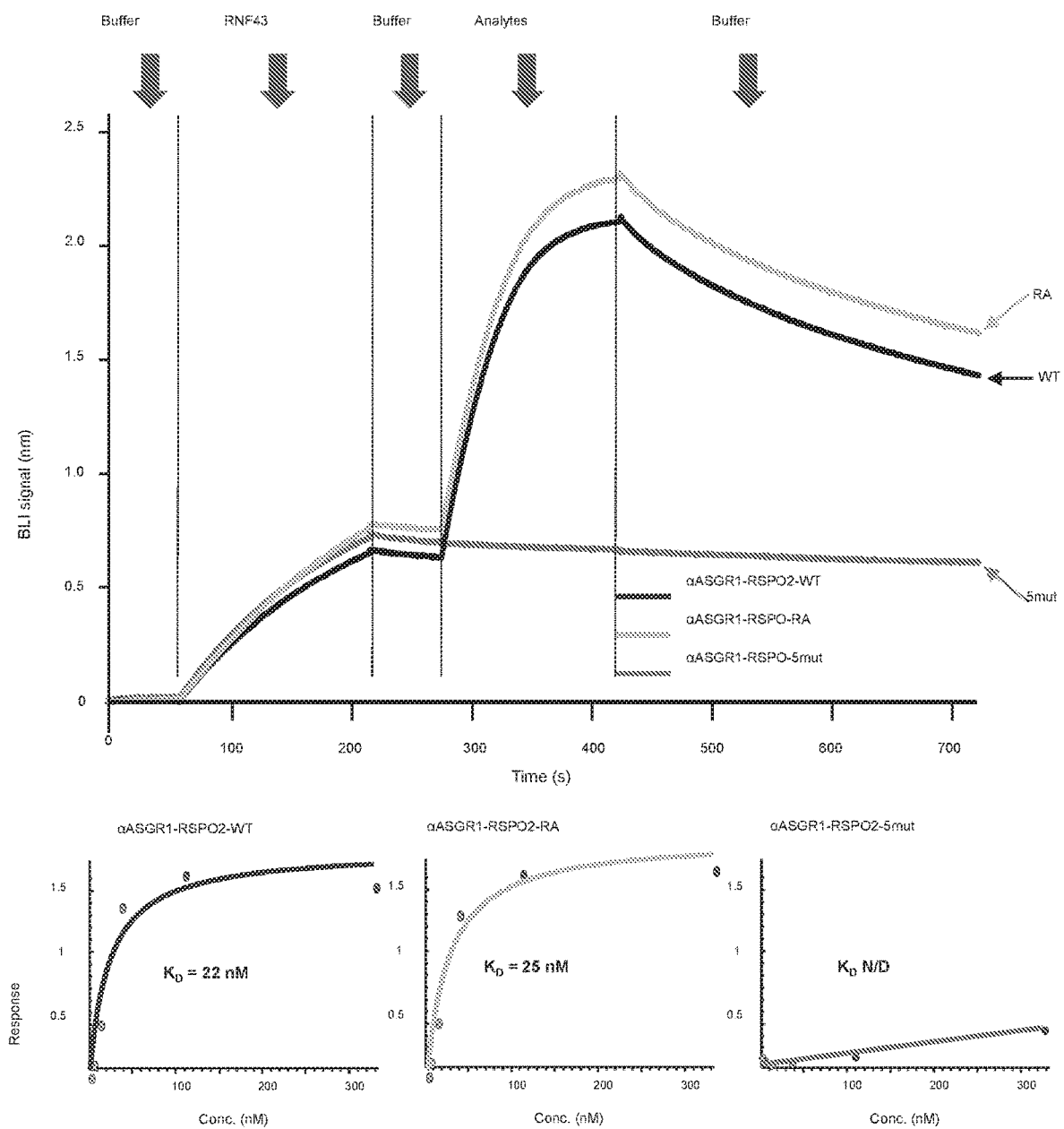
Figure 1D:
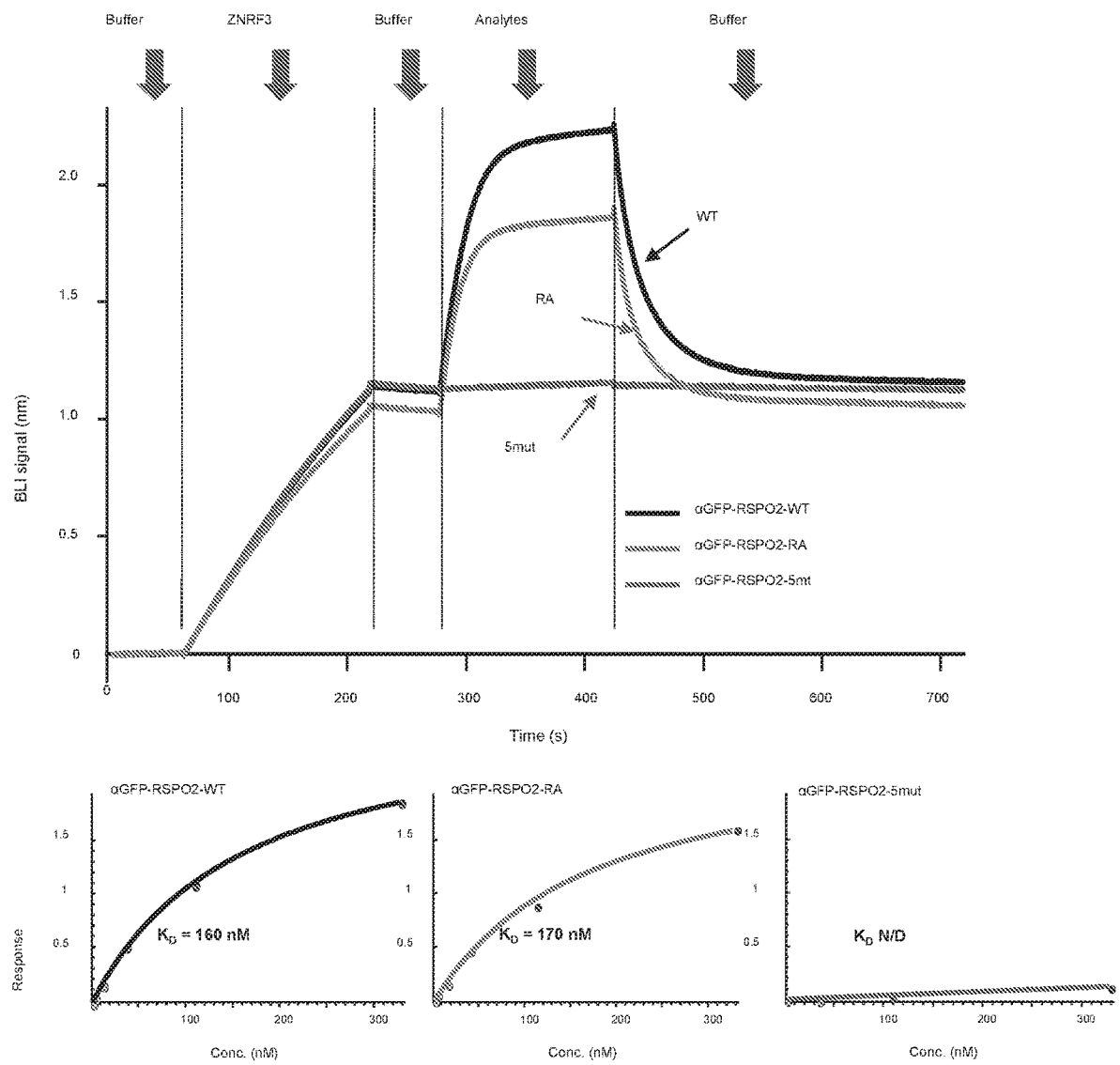
Figure 1D:
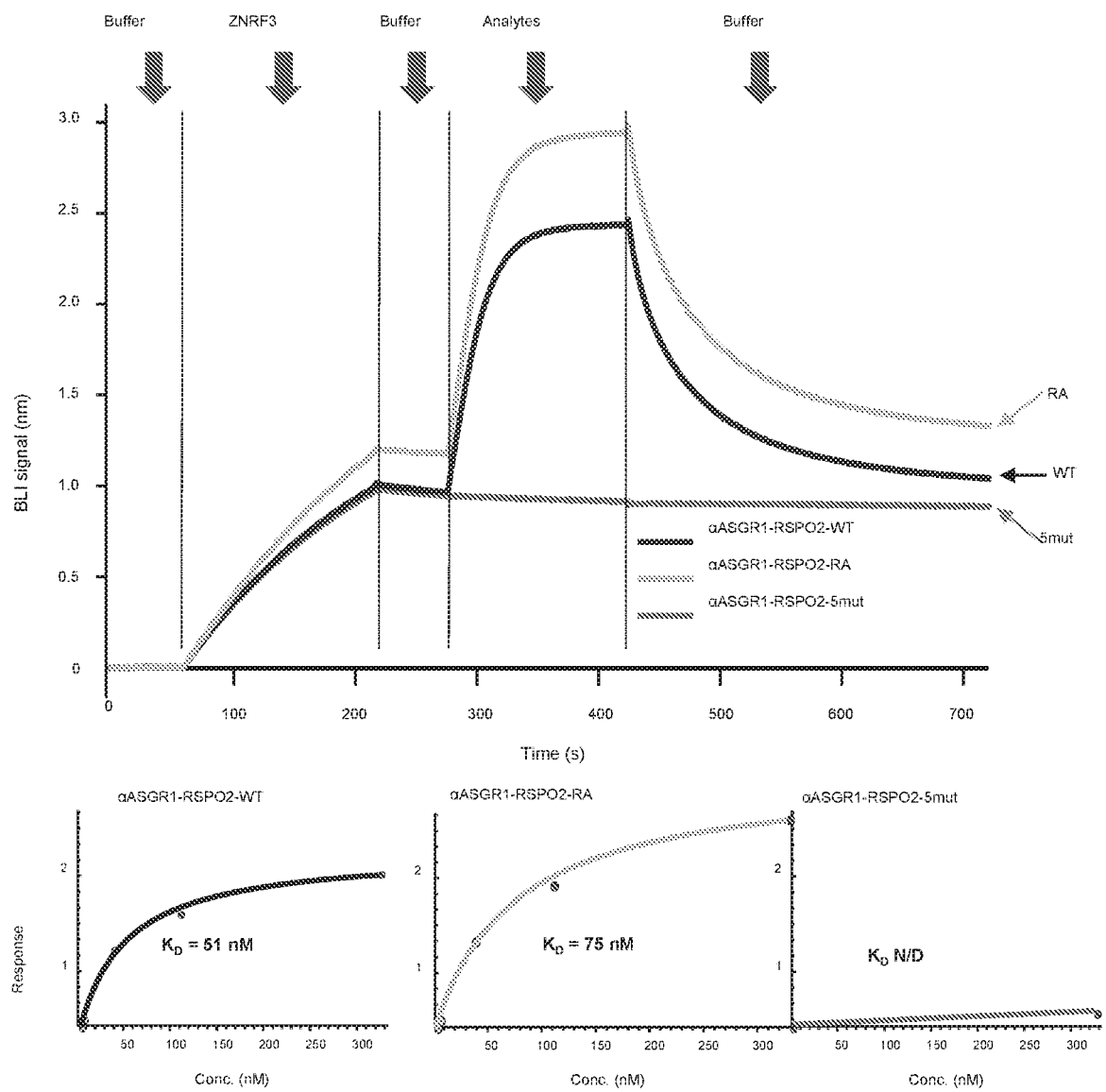

Switching the targeting module from anti-GFP to anti-ASGR1 had no apparent effect on the interaction of RSPO2 to E3 ligases or LGR5 proteins. αASGR1-RSPO2-WT bound to both E3 ligases and LGR5, αASGR1-RSPO2-RA lost the ability to interact with LGR5, and αASGR1-RSPO2-5mut lost the ability to interact with both LGR5 and E3 ligases (FIGS. 1C and 1D).

The ability of these molecules to modulate Wnt signaling was also assessed in both HEK293 STF and Huh-7 STF Wnt responsive reporter cells. In HEK293 STF cells, since they do not express ASGR1 (as verified by semi-quantitative PCR analysis, FIG. 2A), the anti-ASGR1-RSPO2 fusion proteins behaved almost identically to their anti-GFP counterparts (FIG. 2B). In the absence of added Wnt, none of the αASGR1-RSPO2 proteins activated Wnt signaling (FIG. 2B right panel). In the presence of Wnt3a conditioned media (CM), αASGR1-RSPO2-WT enhanced Wnt3a activity in a dose responsive matter similar to αGFP-RSPO2-WT, while αASGR1-RSPO2-RA and αASGR1-RSPO2-5mut were inactive (FIG. 2B). In contrast, in Huh-7 STF cells, a human hepatoma cell line which expresses ASGR1, the fusion of αASGR1 scFv significantly rescued the ability of RSPO2-RA mutant to enhance Wnt3a induced signaling (FIG. 2B, lower left panel). The αASGR1-RSPO2-5mut remained inactive, demonstrating that the activity observed with αASGR1-RSPO2-RA depends on its ability to engage E3 ligases. Interestingly, αASGR1 scFv fusion to WT RSPO2, αASGR1-RSPO2-WT, also showed a significant, ~6-fold left shift in the dose response curve compared to αGFP-RSPO2-WT (FIG. 2B), suggesting that the attachment of the new targeting module, αASGR1 scFv, may have synergized with LGR to further enhance the WT RSPO2 function.

In addition to the STF reporter system, Wnt signaling activity was also examined directly by Western blot analysis. As shown in FIG. 2C, while the treatment of Huh-7 cells with 10% Wnt3a CM did not induce a significant change, the addition of αGFP-RSPO2-WT enhanced the Wnt3a response and significantly increased both the phosphorylated LRP6 and DVL2 proteins in addition to increasing the total levels of LRP6 protein. The mutations in Fu2 abolished this enhancement activity as seen in the αGFP-RSPO2-RA treated cells. However, the fusion to αASGR scFv, αASGR1-RSPO2-RA, rescued the loss of function phenotype with αGFP-RSPO2-RA, slightly increased the total LRP6 protein as well as significantly increased the phosphorylated levels LRP6 and, to a lesser extent, DVL2 (FIG. 2C).

Figure 2B:
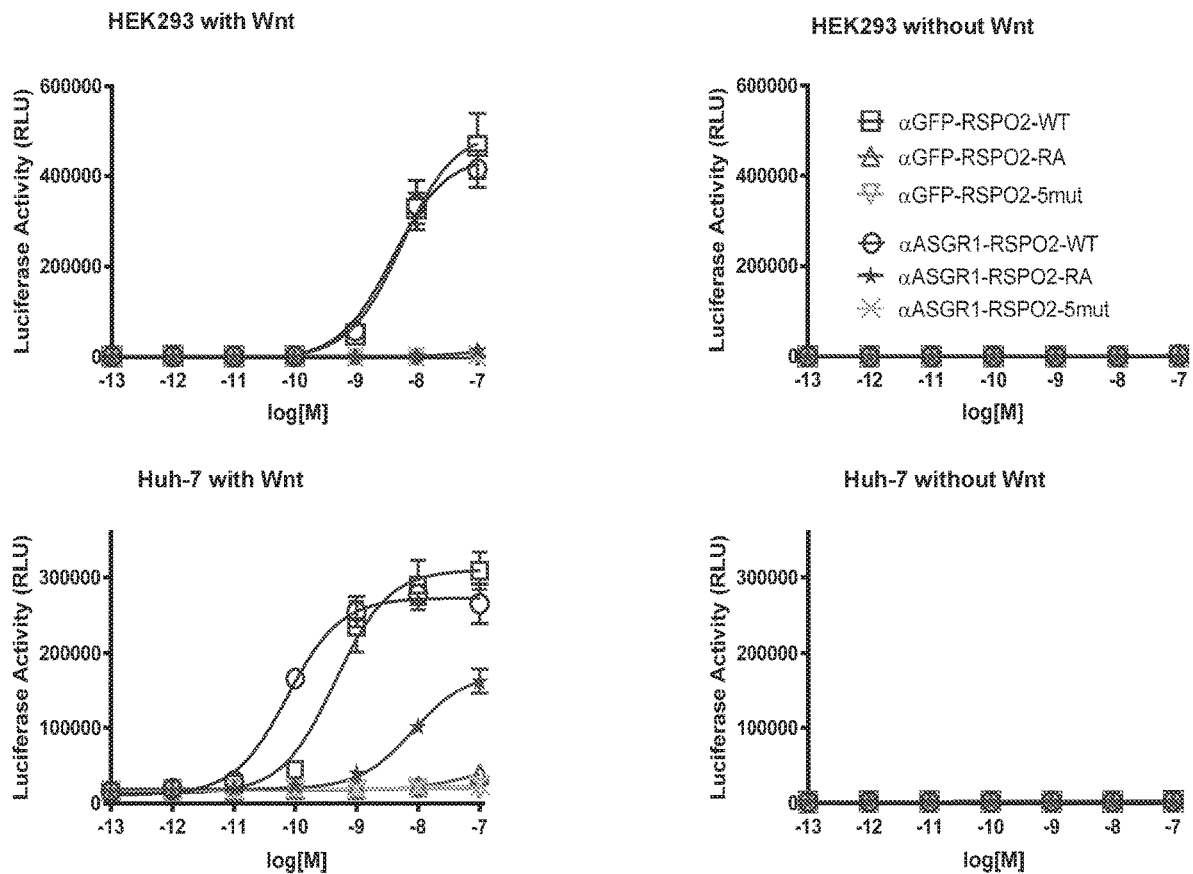
Figure 3A:
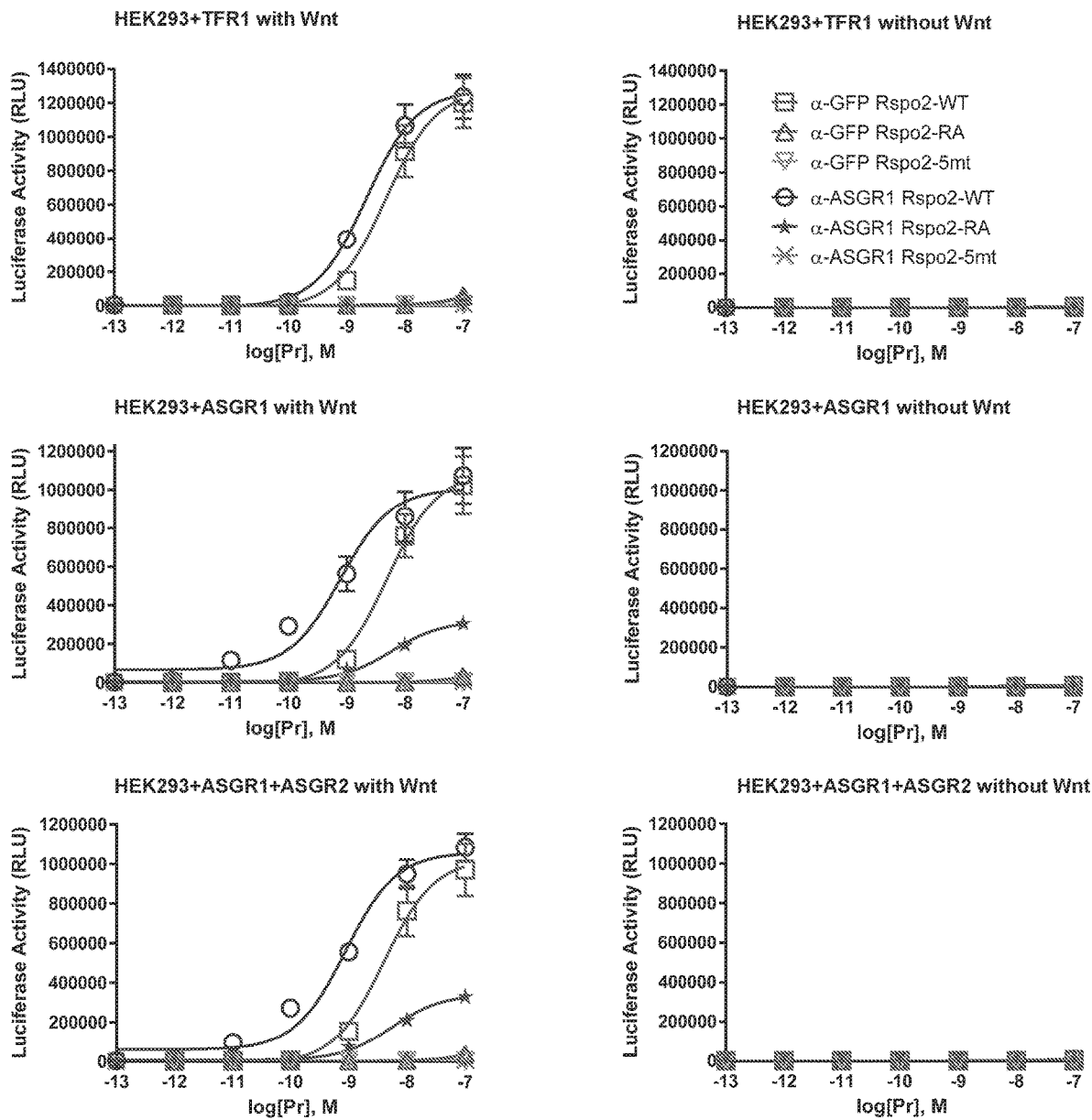
FIGS. 3A-3C. Dependence of the specific Wnt signal enhancer activity on the targeted receptor.

To further confirm the cell-type specific activity of the anti-ASGR1 RSPO2-RA fusion protein is dependent on the presence of the targeted receptor, ASGR, we transiently transfected HEK293 cells with a plasmid encoding a full length human ASGR1 cDNA. Since ASGR1 and ASGR2 form a complex, co-transfection of both of the ASGR cDNAs was also performed in addition to transfection of an unrelated receptor, human transferrin receptor 1 (TFR1, encoded by TFRC gene) as a negative control. Similar to the untransfected parental HEK293 cells, only the RSPO2-WT fusion proteins with either αGFP- or αASGR1-enhanced Wnt signaling in a Wnt dependent manner in cells transfected with TFRC (compare FIG. 2B top panels to FIG. 3A, top panels). In contrast, in cells transfected with either ASGR1 alone or co-transfected with both ASGR1 and ASGR2, the fusion of αASGR1 scFv partially rescued the loss of function RSPO2-RA mutant's ability to enhance Wnt signaling. The fusion of αASGR1 also left shifted the dose response of RSPO2-WT protein, similar to what was observed in Huh-7 cells (compare FIG. 2B, lower panels, to FIG. 3A, middle and lower panels). The activities of the αASGR1-RSPO fusion molecules were also completely dependent on the presence of Wnt ligands (FIG. 3A right panels).

Figure 2A:
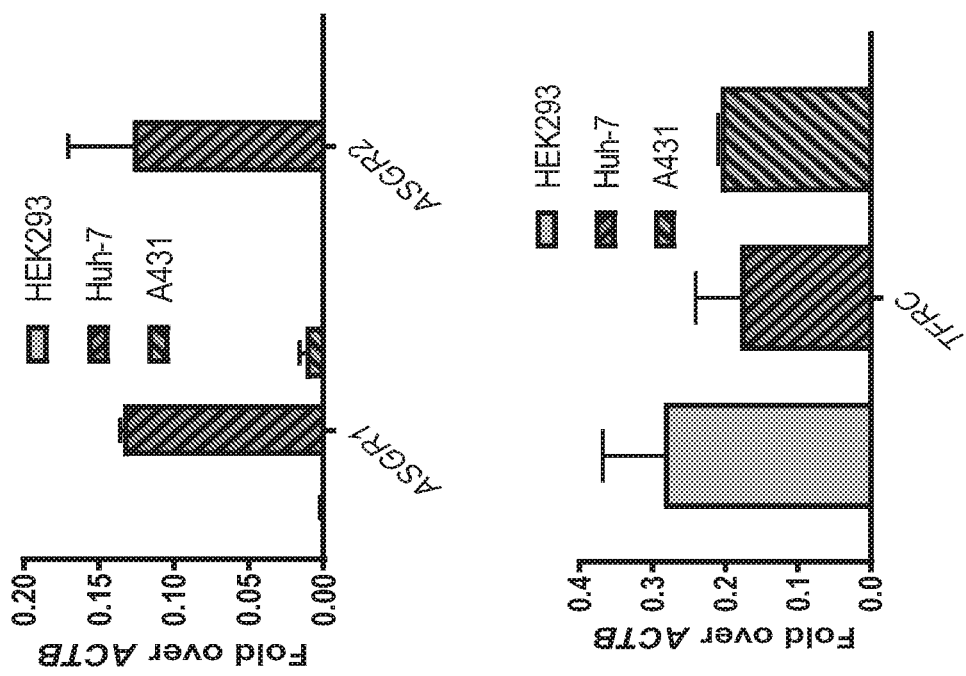
Figure 3B:
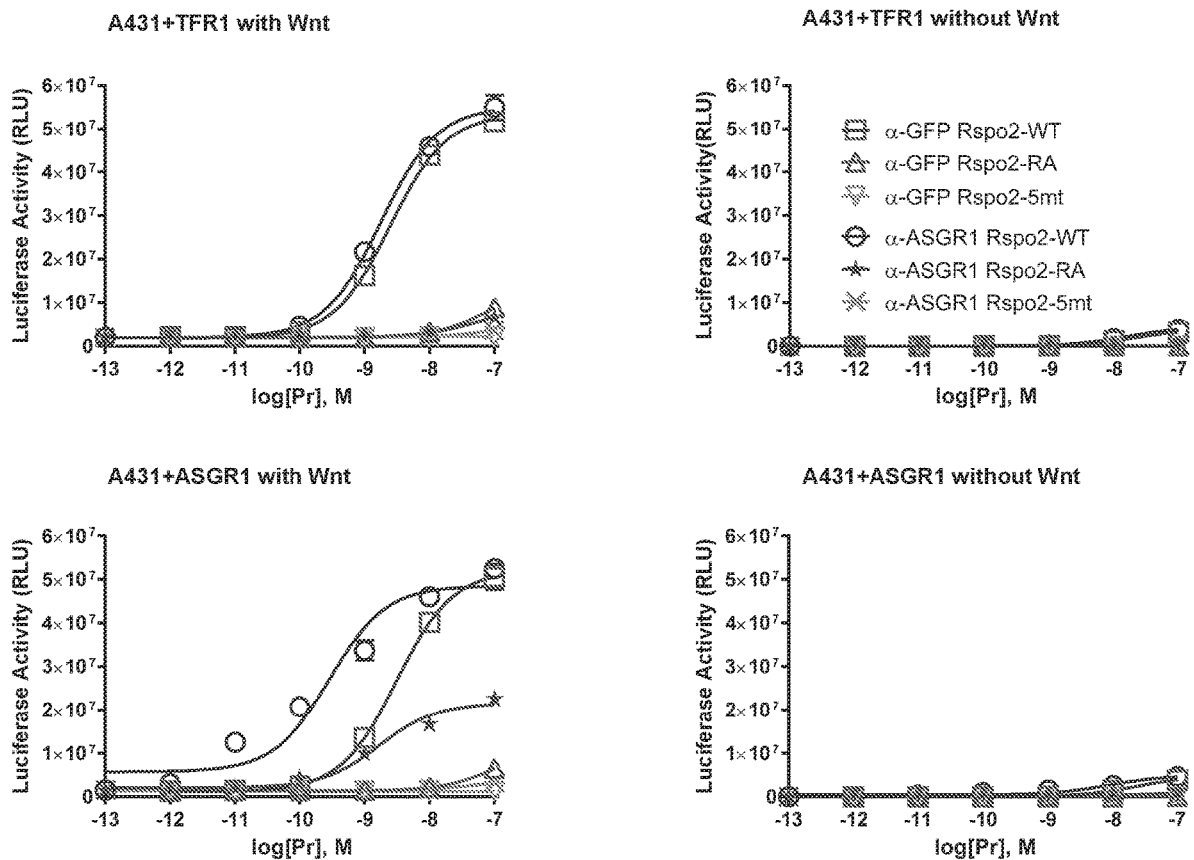

The ASGR1-dependent activity was also confirmed in another ASGR1 negative cell line, A431, which is derived from human epidermoid carcinoma and doesn't express ASGR genes (FIG. 2A). Similar to HEK293 transfection studies, αASGR1-RSPO2-RA only rescued RSPO2-RA activity in A431 cells expression ASGR1 but not in A431 cells expressing the negative control receptor, TFR1 (FIG. 3B). Furthermore, αASGR1 scFv also left shifted RSPO2-WT dose response curve and all RSPO derivatives' activities were completely dependent on the presence of Wnt ligand (FIG. 3B, right panels). All the results together from FIGS. 2 and 3 demonstrated that RSPO-mediated Wnt signal enhancing activity can be replaced by targeting to a different cell surface receptor, ASGR1, in place of LGR. The resulting RSPO mimetic molecule resembles WT RSPO in Wnt dependency and its action through E3 ligases, but differs in that its Wnt signaling enhancement is cell-type specific.

Figure 3C:
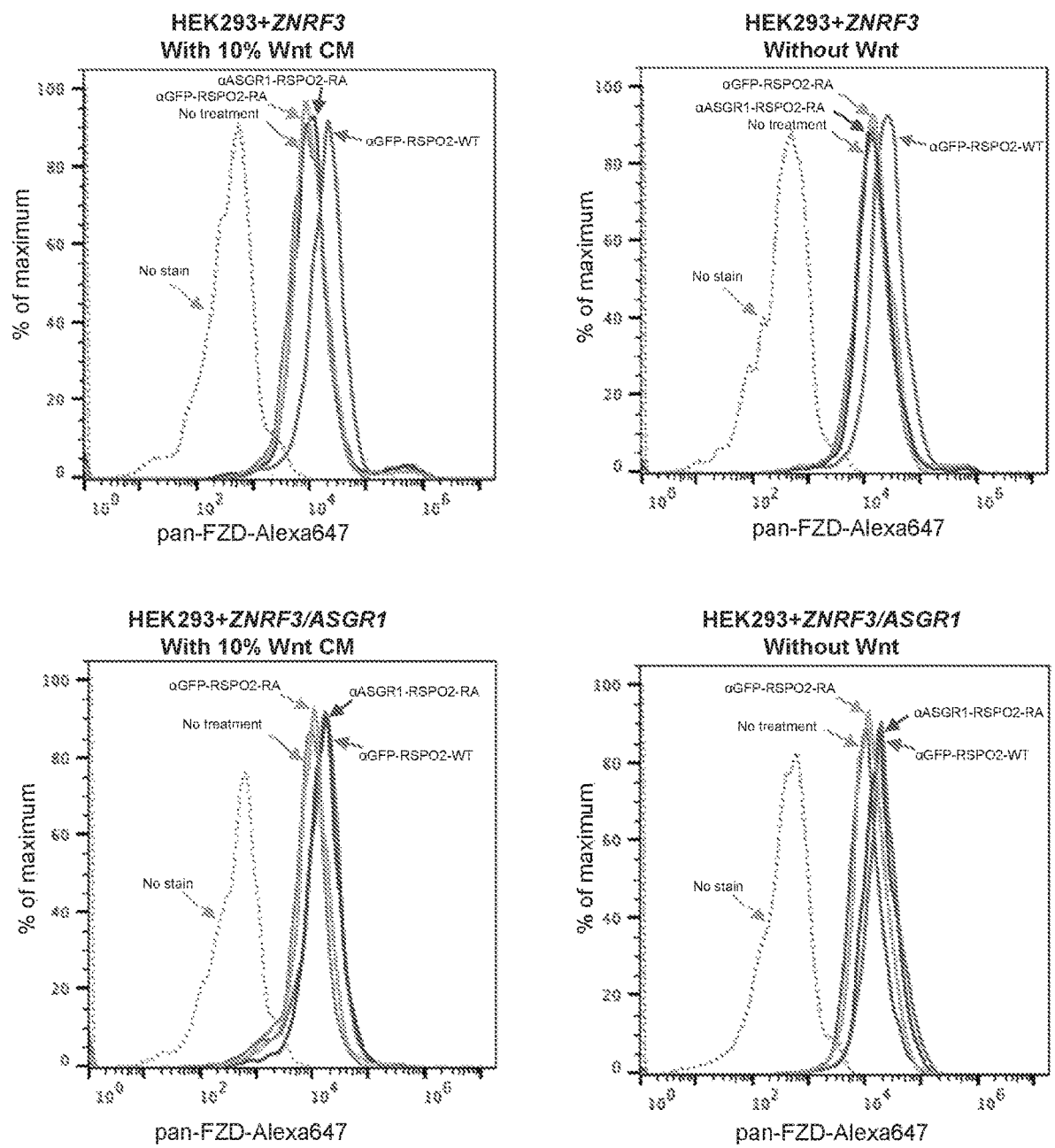

To further validate the mechanism of action of the RSPO derivative molecules, Frizzled (FZD) receptor levels on the cell surface were examined. To sensitize the system, ZNRF3 was over-expressed by transient transfection before treatment. A pan-Frizzled antibody 18R5 (cloned based on Patent EP2331136A4) was used to stain the cells, and found αGFP-RSP2-WT clearly increased the signal (as expected) as compared to the untreated cells, and such a shift was not observed with αGFP-RSPO2-RA or αASGR1-RSPO2-RA treatment (FIG. 3C, top). This is consistent with the lack of activity of these two RSPO-RA constructs in HEK293 cells. On the other hand, when the cells were co-transfected with both ZNRF3 and ASGR1, αASGR1-RSPO2-RA increased pan-FZD staining just like αGFP-RSPO2-WT, leaving αGFP-RSPO2-RA being similar to the untreated cells (FIG. 3C, bottom). This is consistent with the removal of the ZNRF3/RNF43 E3 ligases by RSPO or RSPO mimetics, which leads to the stabilization of Wnt receptors.

Figure 4A:
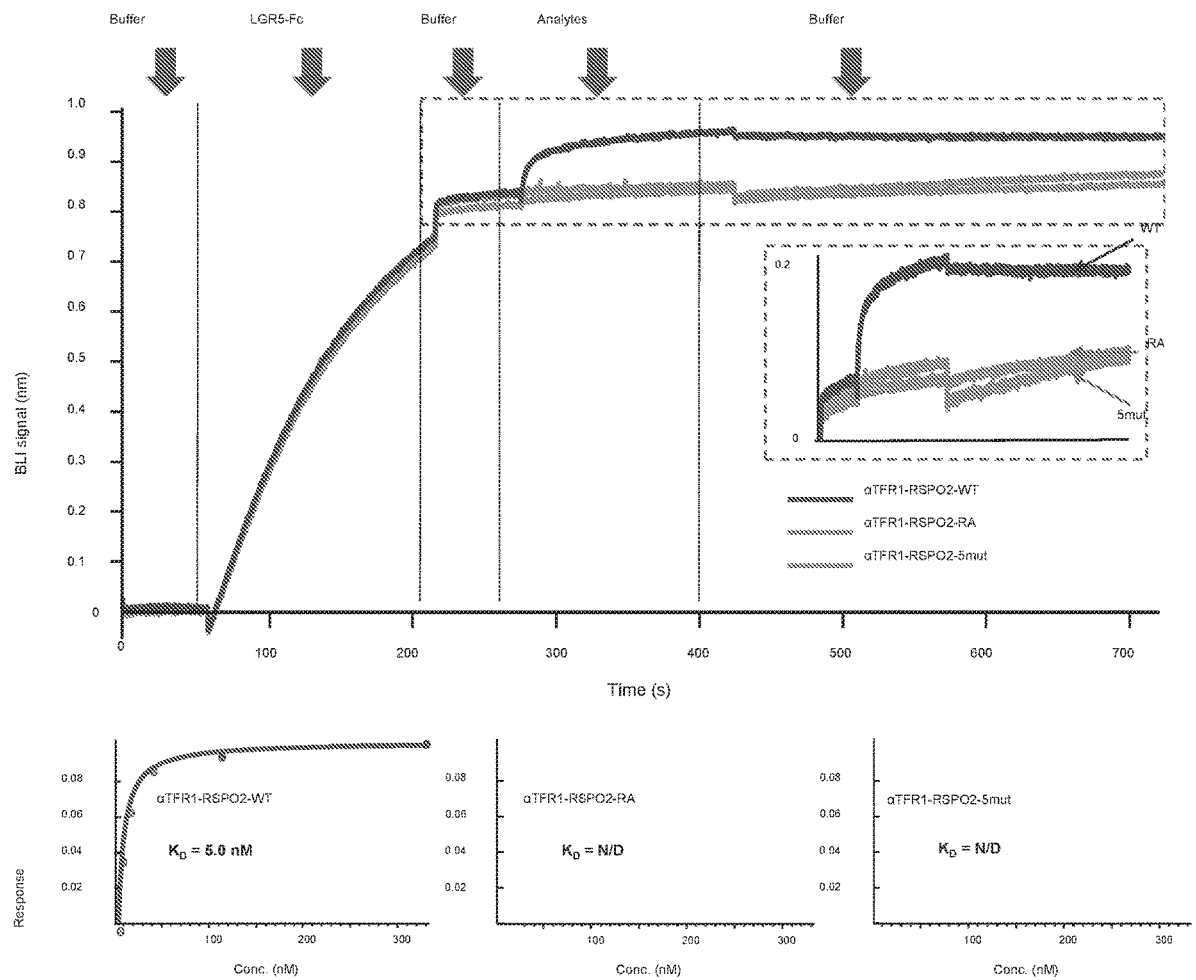
Figure 4B:
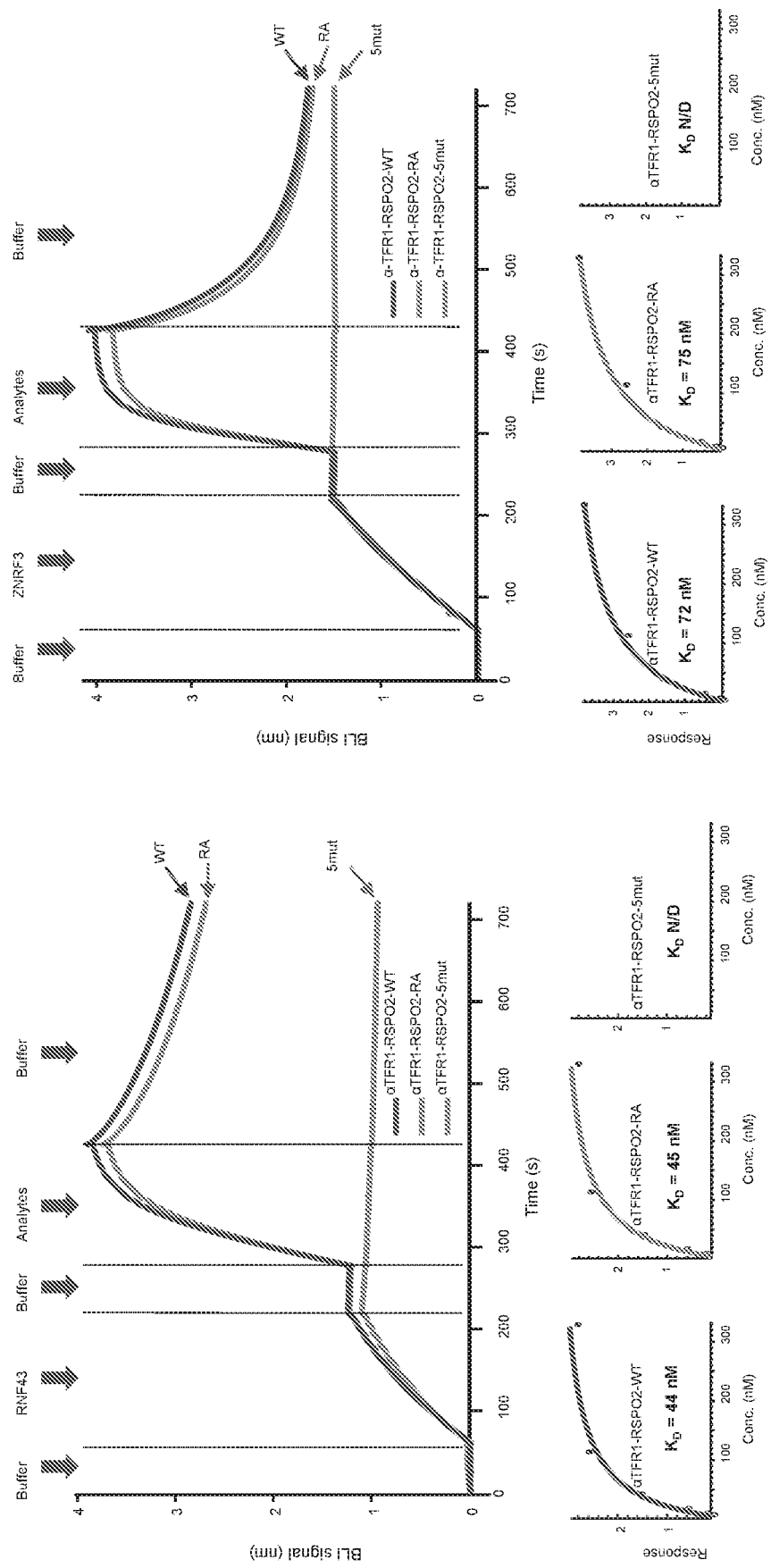
Figure 4C:
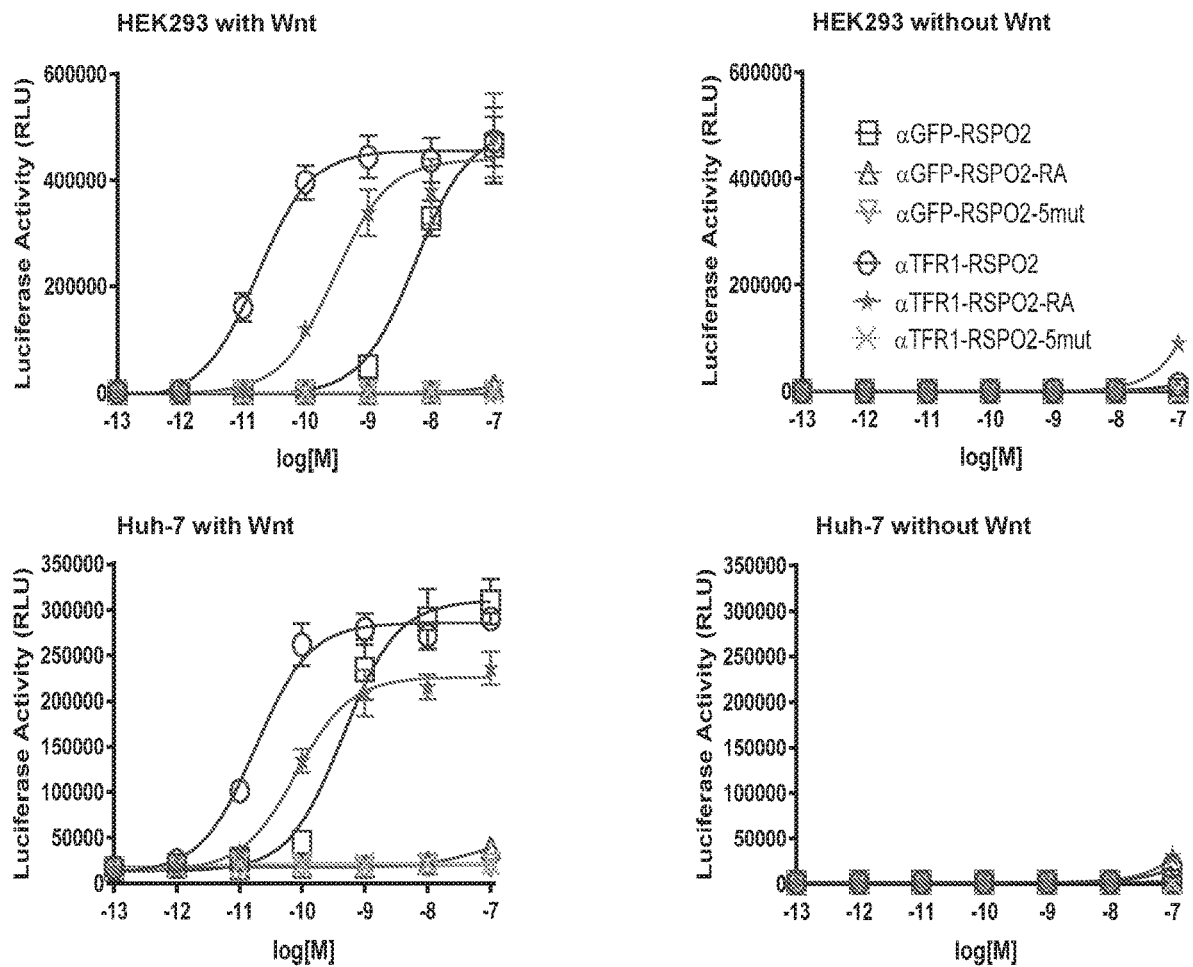

To validate the ability of the tissue-specific Wnt signal enhancing molecules to enhance Wnt signaling in additional cell-types, a second novel, bispecific construct targeting a different cell surface receptor, the transferrin receptor 1 (TFR1), was tested. TFR1 is encoded by the TFRC gene, and is broadly expressed in many cell types. It has been reported to undergo continuous endocytosis. Fusion proteins containing an scFv binder to human TFR1, RSPO2-WT, RSPO2-RA, or RSPO2-5mut (SEQID NOs: 17-22) were constructed and characterized. The had a design similar to FIG. 1B, except that the anti-GFP or anti-ASGR1 component was replaced by an anti-TFR1 scFv. Similar to the anti-GFP or anti-ASGR1 fusion proteins, the αTFR1-RSPO2-RA protein lost the ability to interact with LGR5, and the αTFR1-RSPO2-5mut lost the ability to interact with both LGR5 and E3 ligases (FIGS. 4A-B). When tested in the HEK293 STF reporter assay in the presence of Wnt sources, the TFR1 targeted RSPO2-RA (αTFR1-RSPO2-RA) stimulated Wnt signaling and exhibited ~20-fold greater potency compared to wild-type RSPO (αGFP-RSPO2-WT). (FIG. 4C). The anti-TFR1 RSPO2-WT fusion, αTFR1-RSPO2-WT, further improved the $EC_{50}$ by another ~20-fold, for a nearly 400-fold improved potency compared to αGFP-RSPO2-WT. Similar results were obtained in the Huh-7 STF cells, consistent with the expression of the targeted receptor in both cell lines (FIG. 2A). Consistent with the mechanism of RSPO, no Wnt signaling was observed in the absence of Wnt ligand with anti-TFR1 RSPO mimetic molecules (FIG. 4C, right panels). The more potent activity observed with anti-TFR1 RSPO2 fusion proteins indicates that the particular combination of receptor and binder may play a role in the activity of tissue-specific Wnt signal enhancing molecules.

Figure 4D:
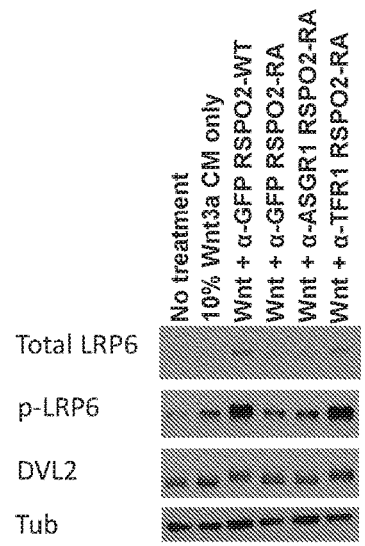

As was seen with αGFP-RSPO2-WT, αTFR1-RSPO2-RA, but not αASGR1-RSPO2-RA, stimulated the phosphorylation of LRP6 and DVL2 in the presence of Wnt stimulation in HEK293 STF cells and increased total LRP6 protein levels (FIG. 4D). The effects of the RSPO mimetic molecule on FZD receptor levels on the cell surface was also examined by flow cytometry analysis. As shown in FIG. 4E, treatment of HEK293 cells with αGFP-RSPO2-WT, αTFR1-RSPO2-RA, but not αGFP-RSPO2-RA increased the FZD receptor levels on these cells measured by the pan-FZD antibody.

Example 2

Figure 5A:
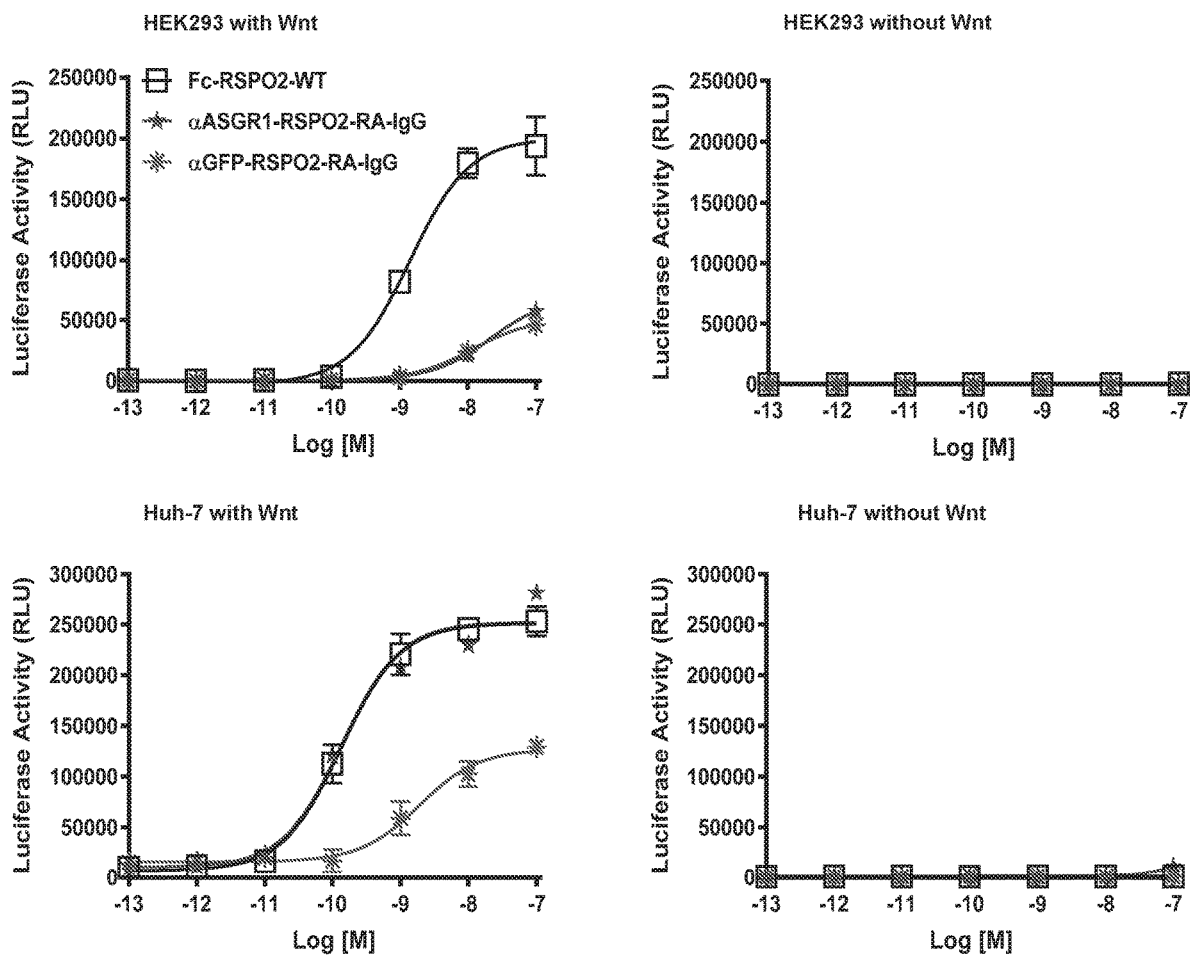
FIGS. 5A-5D. Wnt-response gene, Axing, induction by the hepatocyte-specific Wnt signal enhancing molecule.
Figure 5B:
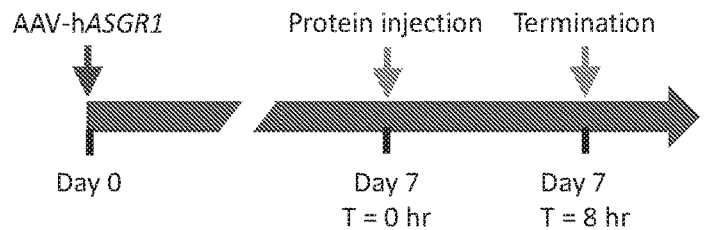

In Vivo Liver Effect Using a Prototype Liver-Specific Wnt Signaling Enhancing Molecule To demonstrate that αASGR1-RSPO2-RA can activate the Wnt-signaling pathway in a tissue specific manner in vivo, mice were treated with αASGR1-RSPO2-RA and control proteins. Since the molecular weight of scFv-RSPO2 fusion proteins are in the range of ~40 kDa, to increase their plasma half-life, we switched the scFv of the binders to the IgG format where the RSPO2 is fused to the N-terminus of the IgG heavy chain. αASGR1-RSPO2-RA-IgG (SEQ ID NOs: 29-32) had similar potency as αGFP-RSPO2-RA-IgG (SEQ ID NOs: 25-28) in HEK293 cells, but was much more potent and efficacious than the latter in Huh-7 cells (FIG. 5A). In fact, the activity αASGR1-RSPO2-RA-IgG at 100 pM is comparable to that of αGFP-RSPO2-RA-IgG at 10 nM (FIG. 5A bottom left), suggesting the strong targeting effect is preserved in the IgG format.

Expression of human ASGR1 in mouse liver was induced by IV injection of ssAAV8-CAG-hASGR1, using $1 \times 10^{11}$ genomic particles per mouse, a dose was shown to achieve transgene expression levels equivalent to the endogenous liver Asgr1 mRNA, 7 days prior to treatment with recombinant proteins (data not shown).

Figure 5C:
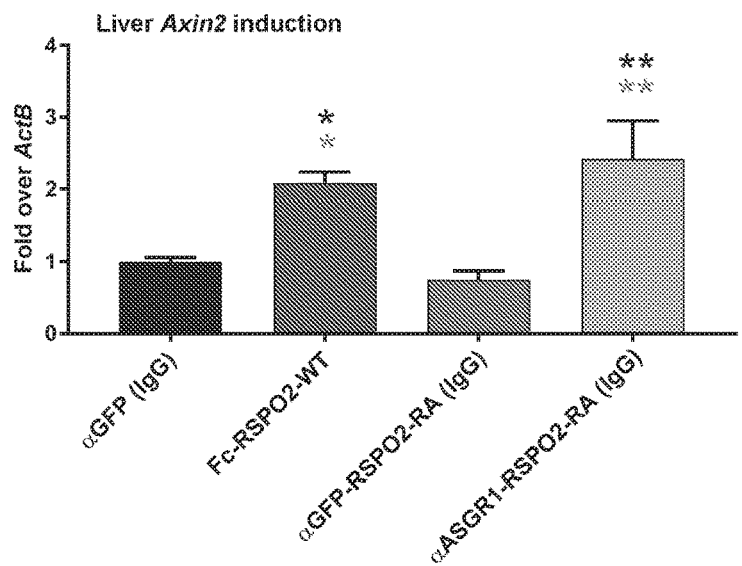
Figure 5D:
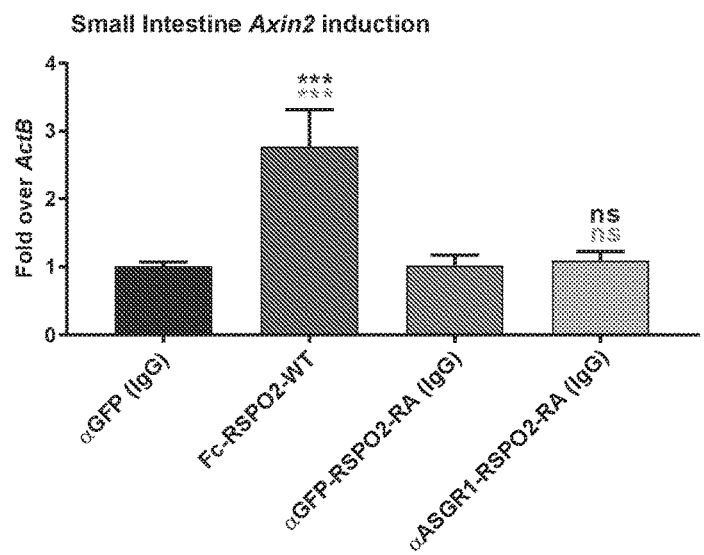

In a first study (FIG. 5B), mice were injected i.p. with an equimolar dose of αGFP-IgG (SEQ ID NOs: 25-26 and 33-34) (1 mg/kg), Fc-RSPO2-WT (SEQ ID NOs: 23-24) (0.46 mg/kg), αGFP-RSPO2-RA-IgG (SEQ ID NOs: 25-28) (1 mg/kg), or αASGR1-RSPO2-RA-IgG (SEQ ID NOs: 29-32) (1 mg/kg) recombinant proteins (with approximately matching molarity, n=8 mice per group). Liver and small intestine samples were collected 8 hrs later for expression analysis. Treatment with Fc-RSPO2-WT and αASGR1-RSPO2-RA-IgG induced liver Axin2 expression significantly when compared to liver Axin2 expression in mice treated with either the αGFP or αGFP-RSPO2-RA-IgG negative controls (FIG. 5C). In contrast, treatment with Fc-RSPO2-WT, but not with αASGR1-RSPO2-RA-IgG increased small intestine Axin2 expression significantly (FIG. 5D). These results suggest that αASGR1-RSP2-RA-IgG can activate the Wnt pathway in a tissue-specific manner in vivo.

Figure 6D:
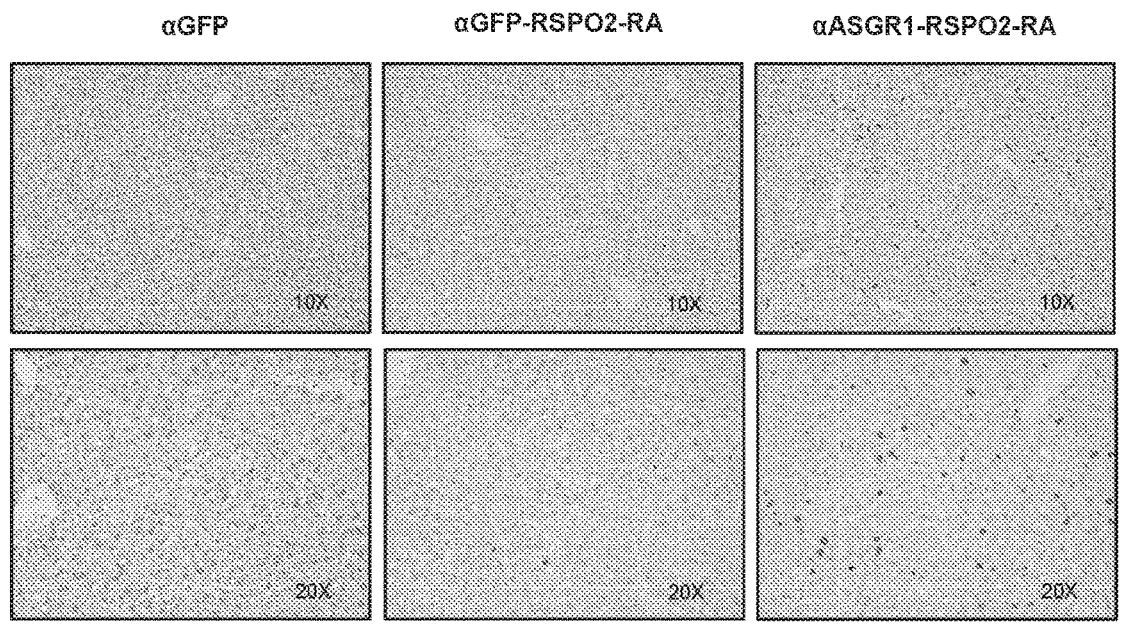
Figure 6E:
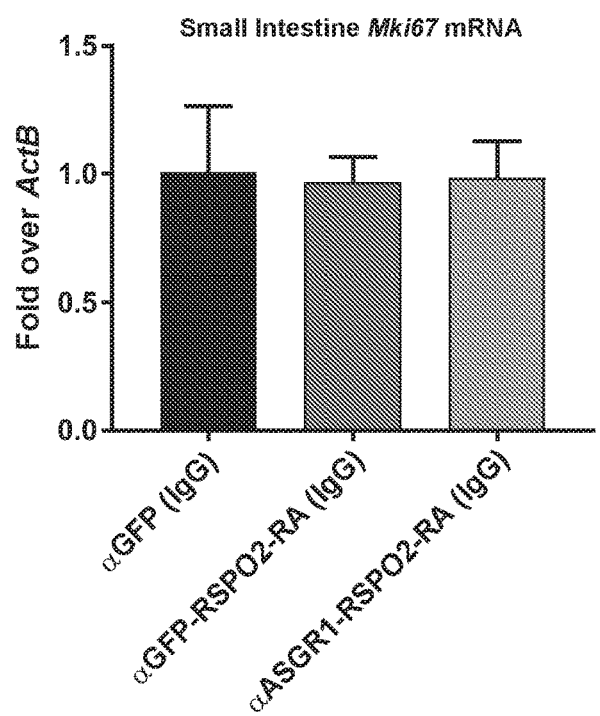

In a second study (FIG. 6A), mice were injected i.p. with αGFP-IgG (1 mg/kg), αGFP-RSPO2-RA-IgG (1 mg/kg), or αASGR1-RSPO2-RA-IgG (1 mg/kg) recombinant proteins (n=10 mice per group). Liver and small intestine samples were collected 48 hrs later for expression analysis and histoimmunochemistry. Treatment with αASGR1-RSPO2-RA-IgG induced expression of the cellular proliferation marker gene Mki67 (FIG. 6B), and increased the number of Ki-67-positive cells (FIGS. 6C-D) significantly in liver when compared to mice treated with either the αGFP-IgG or αGFP-RSPO2-RA-IgG negative controls. In contrast, this induction of Mki67 expression by αASGR1-RSPO2-RA-IgG was not observed in small intestine (FIG. 5E). These results suggest that αASGR1-RSPO2-RA-IgG can stimulate proliferation in liver parenchymal cells in a tissue specific manner.

Example 3

Generation of Antibodies

Antibodies directed against ASGR, ZNRF3 and RNF43 polypeptide sequences were identified. For the production of recombinant proteins for antibody screening and immunization, extracellular domains (ECDs) of the following proteins were cloned into a pcDNA eukaryotic expression vector with a His/Avi tag: human ASGR1 (hASGR1, NCBI reference sequence NP_001662.1, residues 62-291; SEQ ID NO:35-36 (polynucleotide and polypeptide, respectively)), human ASGR2 (hASGR2, NCBI reference sequence NP_550436.1, residues 66-292; SEQ ID NO:37-38 (polynucleotide and polypeptide, respectively)), cynomolgus ASGR1 (cynoASGR1, sequence ID XP_005582755.1, residues 62-291; SEQ ID NO:39-40 (polynucleotide and polypeptide, respectively)), cynomolgus ASGR2 (cynoASGR2, sequence cloned from cynomolgus liver cDNA sample from Fisher/Zyagen Labs; SEQ ID NO:41-42 (polynucleotide and polypeptide, respectively)), human RNF43 (hRNF43, NCBI reference sequence XP 011523257.1, residues 44-198; SEQ ID NO:43-44 (polynucleotide and polypeptide, respectively)), ZNRF3 (hZNRF3; NCBI reference sequence NP_001193927.1, residues 56-219; SEQ ID NO:45-46 (polynucleotide and polypeptide, respectively)). Constructs were expressed Expi293F cells (Thermo Fisher Scientific), purified by Ni-NTA resin followed by size exclusion chromatography. For phage display, the proteins were biotinylated according to published methods (Janda et al., Nature; 545: 234).

Biotinylated antigens were immobilized for panning against phage display libraries, and positive clones were sequenced. Further analysis was conducted, including expressing in Expi293F cells and characterization for antigen binding.

Non-biotinylated antigen was also used to immunize mice to generate hybridomas. Hybridoma lines were screened by ELISA against immunogen with a control protein containing the same purification tag as controls, and flow cytometry analysis (ASGR-expressing Huh-7 as the test line and ASGR non-expressing HEK293 as the control). Selected hybridoma lines were sequenced, and recombinant Fabs or IgGs were generated consequently for further binding characterization.

Binding characterization of recombinant Fabs or IgG's was carried out using Bio-Layer Interferometry (BLI) using the Octet Red 96 platform (PALL ForteBio, Fremont, Calif.) with streptavidin (SA) coated biosensors (PALL ForteBio,). Biotinylated-antigen was diluted to 50 nM for immobilization onto the sensors. Following immobilization, sensors were dipped into samples containing test molecules at seven concentrations. Values for $K_D$ were determined by fitting the resulting data with a 1:1 binding model. Table 2C provides the binding data for select clones.

Figure 7A:
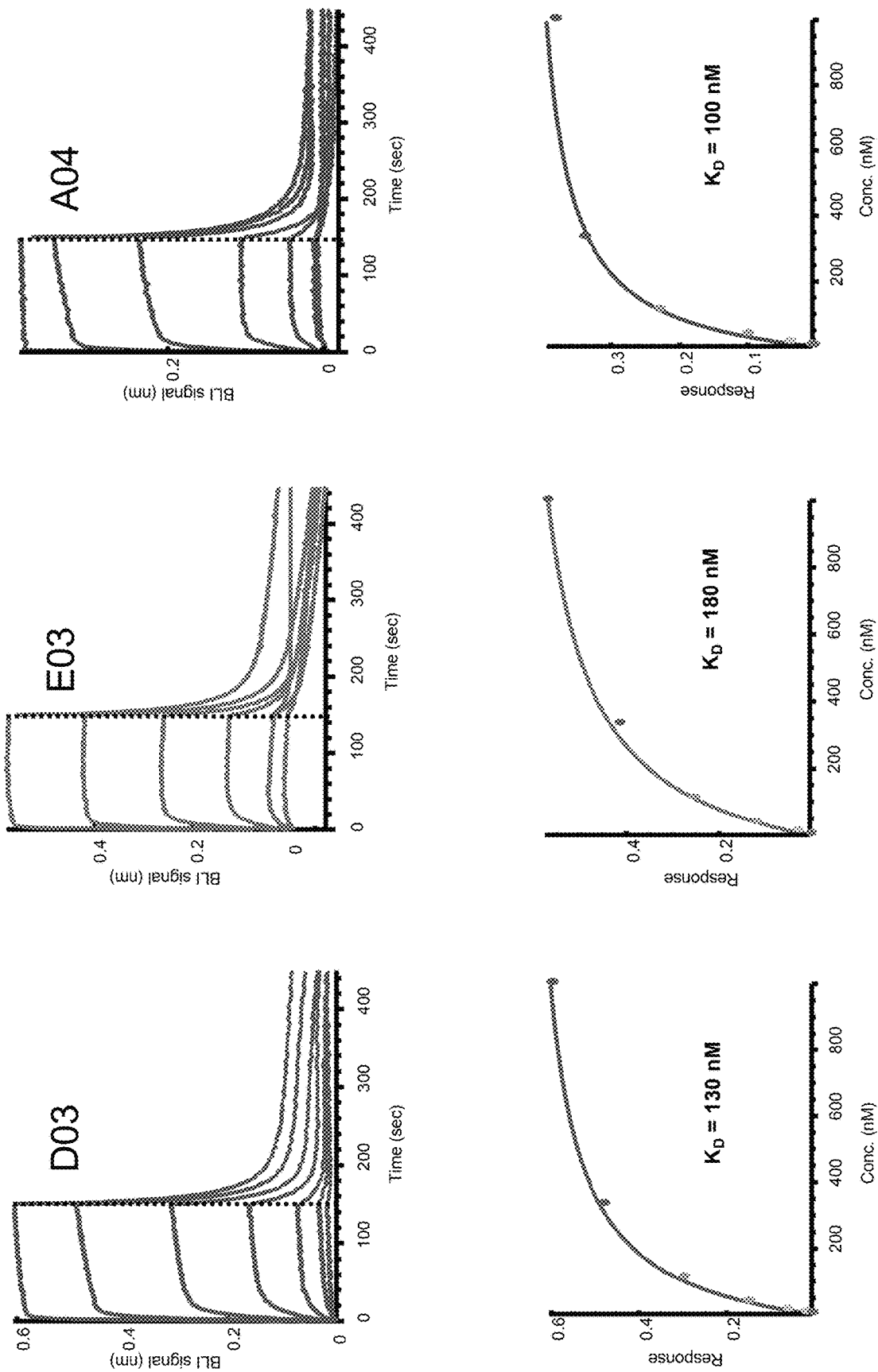
Figure 7B:
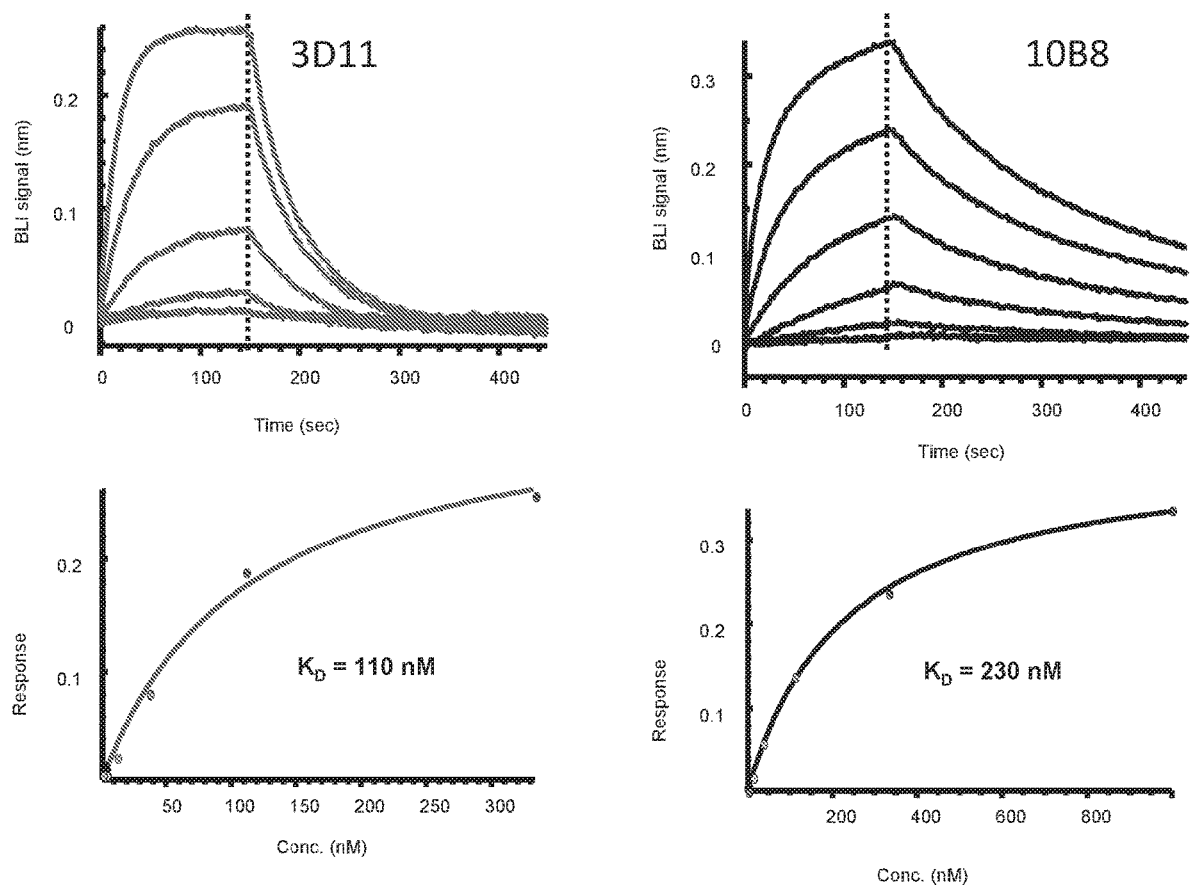

FIG. 7 provides data showing binding of illustrative antibodies identified to hASGR1 (FIGS. 7A and 7C) or hASGR2 (FIG. 7B).

Example 4

Figure 9A:
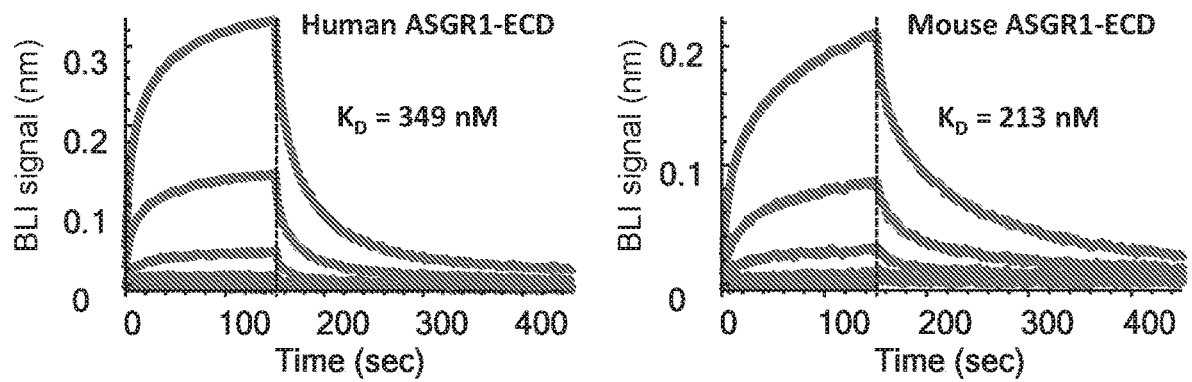

In Vivo Dose-Titration and Tissue-Specificity of Anti-ASGR1-RSPO2-RA in Naïve Healthy Mice The activities of the ASGR1-targeted molecule and control molecules in IgG format were further examined in healthy naïve mice. The αASGR1 antibody (e.g., RO-01) used in these studies had similar affinity to both the human and murine ASGR1 receptors (FIG. 9A).

In this study, six-week old C57Bl/6J male mice were injected intraperitoneally (i.p.) with α-β-Gal-IgG, Fc-RSP02-WT, αGFP-RSPO2-RA or αASGR1-RSPO2-RA at indicated doses (n=8 per group). 48 hours after protein dosing, mice were anesthetized with isoflurane and blood was removed by cardiac puncture. Portions of the left liver lobe and duodenum were collected and either snap-frozen for qPCR analysis or fixed in formalin for 24h, then transferred to 70% EtOH for immunohistochemistry analysis.

Figure 9B:
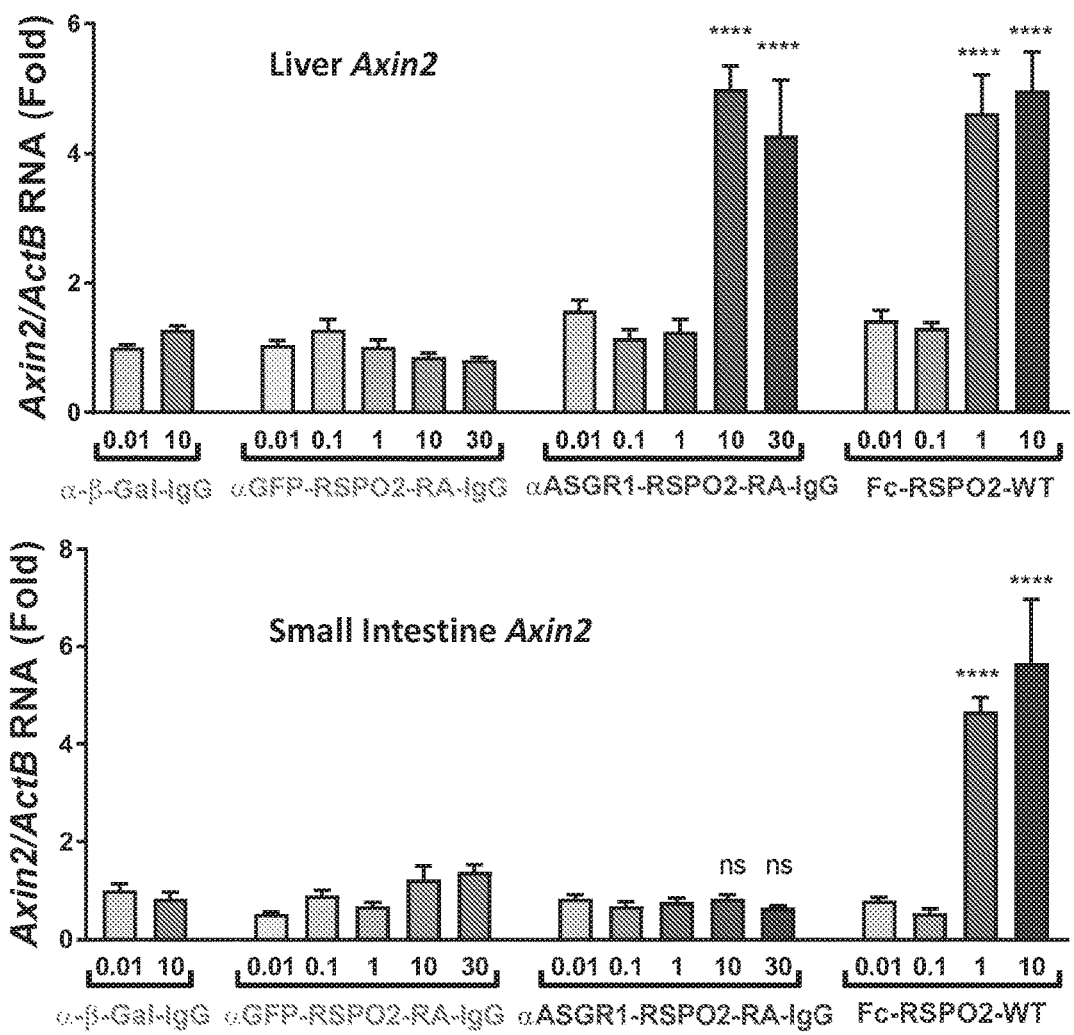

A dose response was performed for αASGR1-RSPO2-RA-IgG (SEQ ID NOs: 29-32) as compared to αGFP-RSPO2-RA-IgG (SEQ ID NOs: 25-28) and other controls to examine induction of Wnt target gene Axing. Mice received intraperitoneal (i.p.) injections of tested proteins at a range from 0.1 to 30 mg/kg. Liver and small intestine samples were collected 48 hours later for gene expression analyses. Fc-RSPO2-WT (SEQ ID NOs: 23-24) increased Axin2 expression at 1 and 10 mg/kg treatment in both liver and small intestine (FIG. 9B). In contrast αASGR1-RSPO2-RA-IgG at 10 and 30 mg/kg induced Axin2 expression only in liver, but not in small intestine. Importantly, this specificity is dependent on αASGR1 targeting module, because the untargeted molecule αGFP-RSPO2-RA-IgG showed no effect in vivo on Axin2 expression in either tissue up to 30 mg/kg treatment (FIG. 9B). No effect was observed with control antibody anti-β-galactosidase (α-β-Gal-IgG, SEQ ID NOs: 155-158), at 0.01 and 10 mg/kg.

Figure 9D:
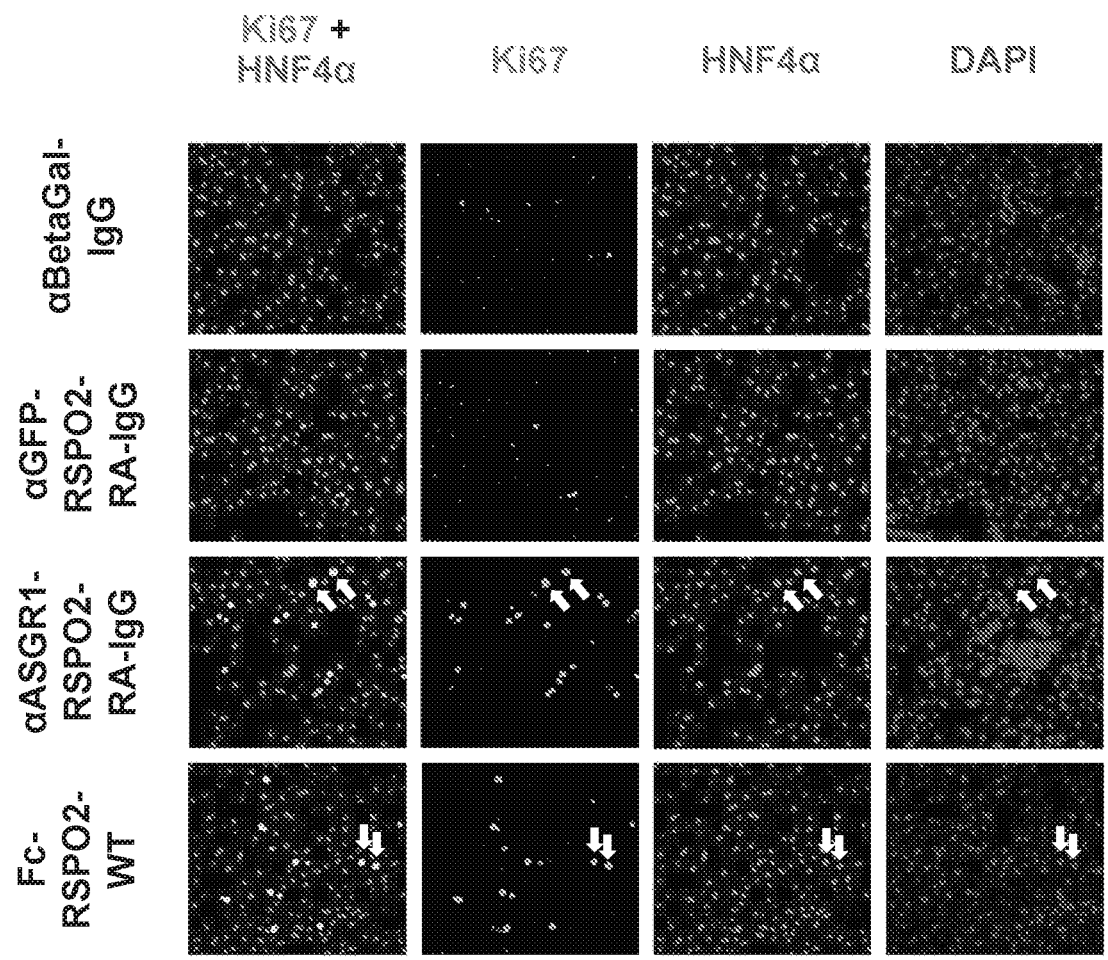

Similar tissue specificity of αASGR1-RSPO2-RA-IgG and dependency on the targeting module was also observed in expression of a proliferation marker Ki67 gene (FIG. 9C). To examine whether or not proliferation occurred in hepatocytes, we co-stained liver samples with antibodies specific for Ki67 protein and one of the mature hepatocyte markers HNF4α. Livers treated with αASGR1-RSPO2-RA-IgG and Fc-RSPO2-WT appeared to have increased numbers of Ki67 positive nuclei that co-localized with HNF4a, while livers treated with αGFP-RSPO2-RA-IgG or α-β-Gal-IgG appeared to have much less Ki67 stain (FIG. 9D). Taken together these results suggested that αASGR1-RSPO2-RA-IgG can activate Wnt pathway in a liver-specific manner in vivo, and that hepatocytes are the primary cell population responsive to this stimulation.

Example 5

Effect of Tissue-Targeted RSPO Mimetics on Liver Function in a Chronic Thioacetamide-Induced Mouse Model of Liver Fibrosis Six-week old C57Bl/6J male mice were treated with thioacetamide (TAA). In Study #1 (Wnt and Rspo gene expression profiling), TAA was added to drinking water at a concentration of 200 mg/L for twenty-seven weeks to induce liver fibrosis. In addition, during the last four weeks of TAA conditioning, mice were administered with TAA i.p. 3 times weekly. In study #2 (liver and small intestine Axing and Ki67 expression at days 3 and 7), TAA was added to drinking water at a concentration of 200 mg/L for twenty weeks to induce liver fibrosis. In addition, during the last six weeks of TAA conditioning, mice were administered with TAA i.p. 3 times weekly. In study #3 (INR analysis at days 3, 7 and 14), TAA was added to drinking water for eighteen weeks. Mice were also administered with 200 mg/kg TAA i.p. 3 times weekly during the last nine weeks of TAA exposure. TAA treatment was discontinued 2 days prior to dosing with recombinant protein, and mice returned to purified, laboratory-grade acidified drinking water. Mice were injected intraperitoneally (i.p.) with recombinant α-β-gal-IgG (10 mpk) or Fc-RSPO2-WT (10 mpk) twice weekly, or αASGR1-RSPO2-RA-IgG (10 mpk) daily. At times indicated, INR was measured using the Roche CoaguChek—XS Plus. At 3, 7 or 14 days after beginning dosing, mice were anesthetized with isoflurane and blood was removed by cardiac puncture. A portion of the left liver lobe and duodenum were collected for analysis. Formalin-fixed and paraffin-embedded liver samples were sectioned and stained with the anti-Ki-67 rabbit antibodies (Abcam, ab15580). The number of Ki-67⁻-positive nuclei per randomly chosen field (100× magnification using 10× objective) were counted using Image J.

Figure 10A:
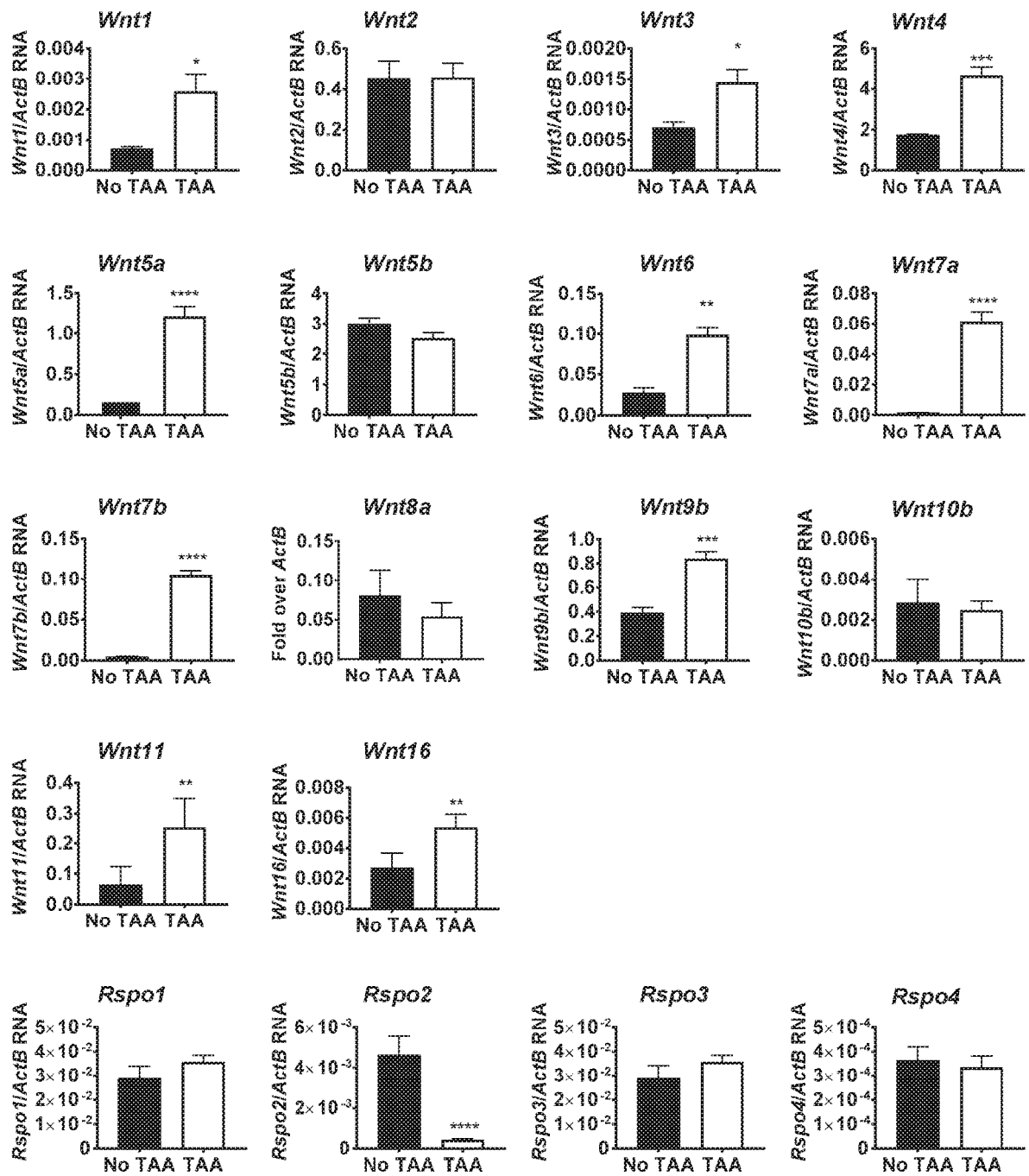
FIGS. 10A-10D. Efficacy of targeted RSPO mimetic in a TAA mouse model of chronic liver disease.

The activity and efficacy of αASGR1-RSPO2-RA-IgG was examined in the chronic thioacetamide (TAA) model, in which extensive liver fibrosis was observed and liver function was impaired. In this model, Wnt signaling pathway components including genes encoding many Wnt ligands were upregulated (FIG. 10A). In contrast, expression of the four R-spondins remained unchanged, or even decreased in the case of Rspo2. Rspo4 was almost nondetectable in the mouse livers (FIG. 10A). Therefore administration of liver-specific RSPO mimetics may be beneficial (FIG. 10A).

Figure 10B:
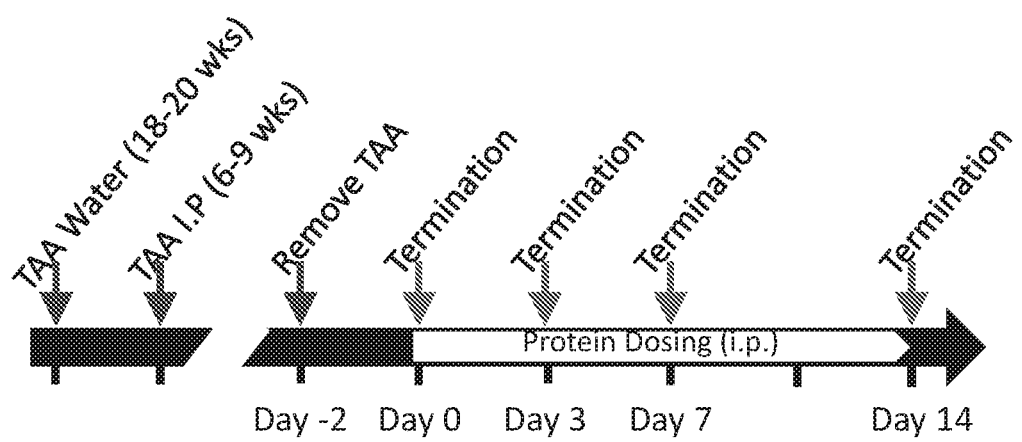
Figure 10C:
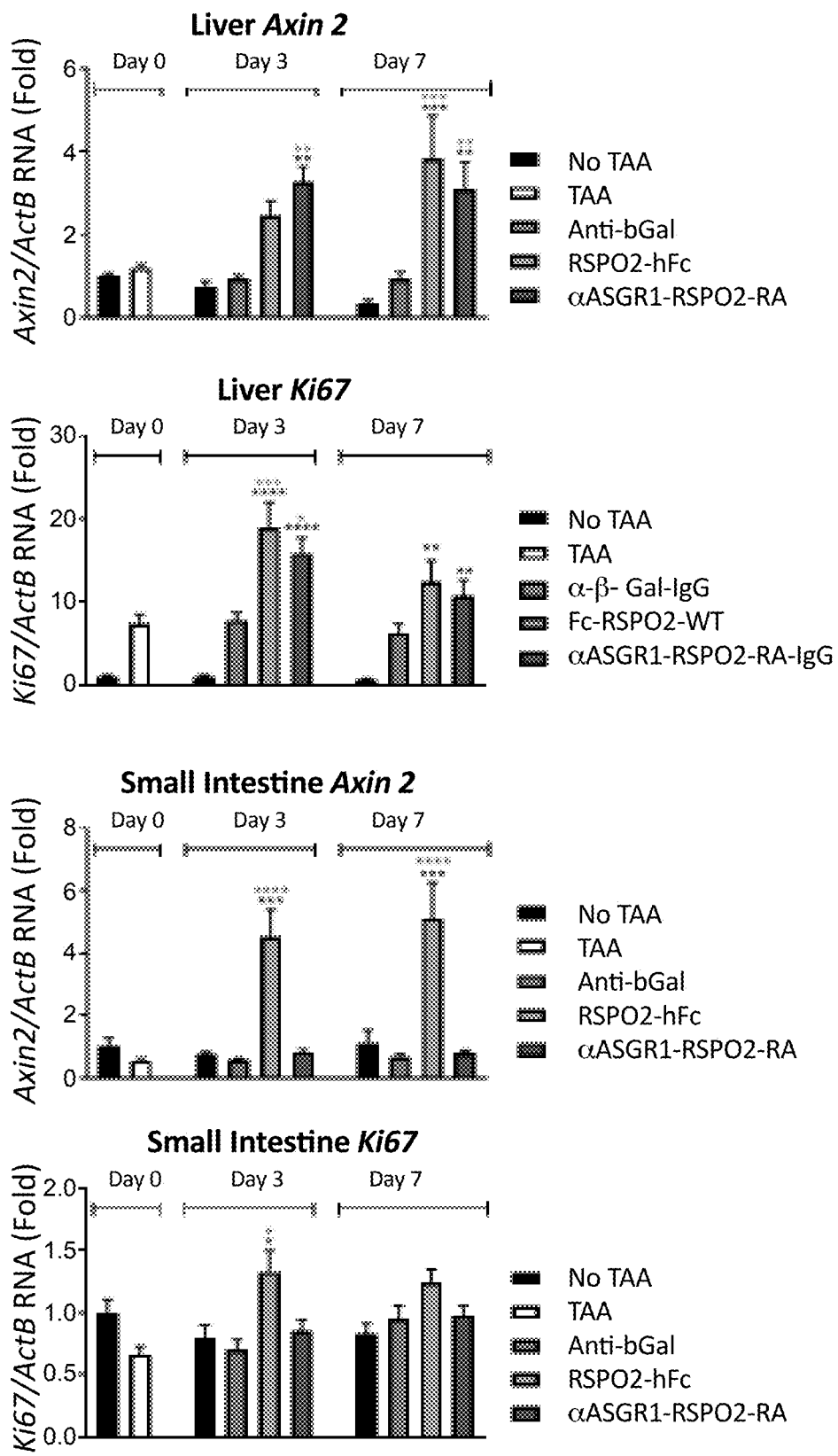

The experimental design outlining the duration of TAA pre-treatment and subsequent protein treatment (αASGR1-RSPO2-RA-IgG and control proteins SEQ ID NOs: 23-24, 29-32, 155-156, and 159-160) is outlined in FIG. 10B. Two studies of similar design were conducted. In one study, mice were terminated at 0, 3, and 7 days following initiation of protein treatment. In a second study, mice were terminated at 0 and 14 days after initiation of protein treatment (FIG. 10B). Liver and small intestine samples were collected and assessed for changes in gene expression. As expected, αASGR1-RSPO2-RA-IgG led to a liver-specific increase of Axin2 expression at days 3 and 7, while Fc-RSPO-WT induced Axin2 in both liver and small intestine (FIG. 10C). No change was observed with the α-β-Gal-IgG control treatment. αASGR1-RSPO2-RA-IgG also increased Ki67 expression in a liver-specific manner (FIG. 10C).

Figure 10D:
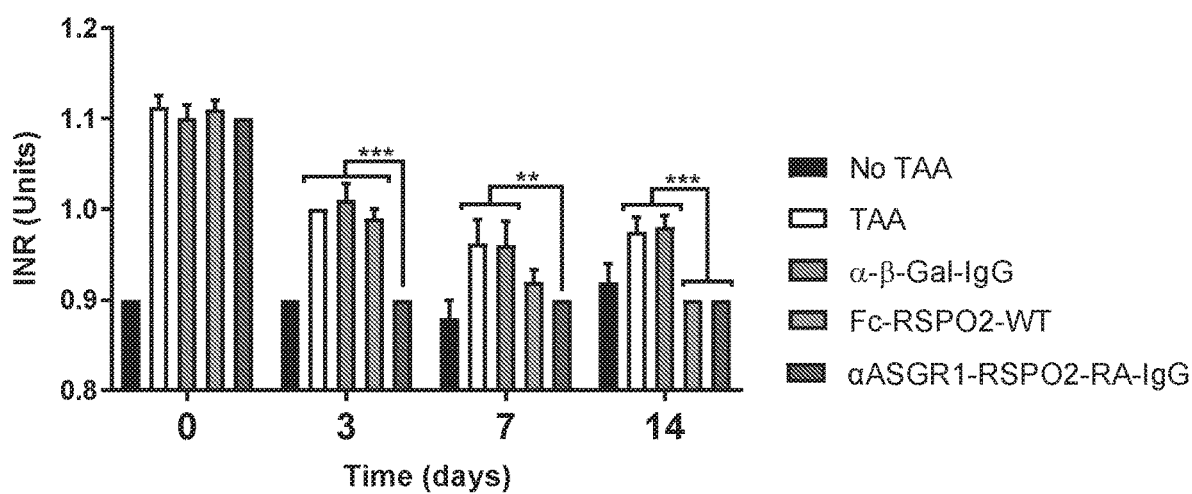

To monitor liver function, blood samples were taken at indicated times during treatment and used to measure International Normalized Ratio (INR) of prothrombin time. The normal mice had an INR of approximately 0.9. TAA treatment increased INR to 1.1 due to serious liver damage (FIG. 10D). Upon TAA removal, mice are known to exhibit some natural resolution of liver damage, consistent with the INR drop observed in untreated animals from 1.1 at day 0 to <1.0 at day 14. However, αASGR1-RSPO2-RA-IgG accelerated INR recovery, as 100% of αASGR1-RSPO2-RA-IgG treated mice had an INR of 0.9 by day 3. Fc-RSPO2-WT treated mice had reduced INR compared to the α-β-Gal treated mice at day 7, and reached the same effect as αASGR1-RSPO2-RA-IgG at day 14. Therefore, the liver-specific αASGR1-RSPO2-RA-IgG molecule can improve liver synthetic function in chronic liver disease model.

Example 6

Figure 12:
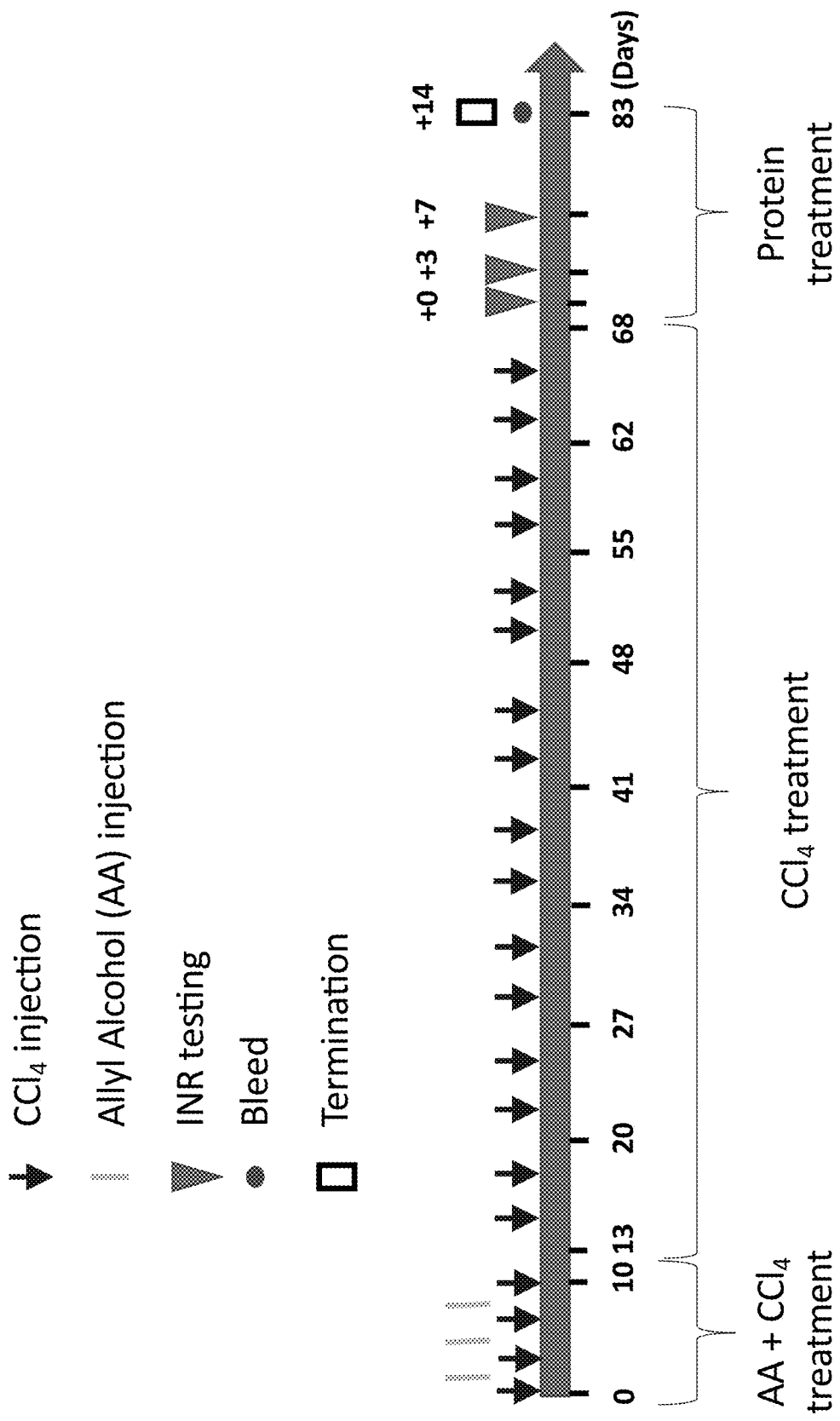
FIG. 12. Scheme of illustrative CCl4-induced liver fibrosis mouse model and treatment protocol. 8-9 week-old C57BL/6 males (Jackson Laboratories) were intermittently treated with CCl4 (0.5 mL/kg at day 1, 4, 7, 10, blue arrows) plus allyl alcohol (0.0125 mL/kg at day 2, 5, 8 yellow arrows) for first 10 days, followed by twice/week of 8 weeks CCl4 treatment (0.5 mL/kg, blue arrows). Following CCl4 treatment, mice were dosed with protein for 2 weeks. Treatment groups are as follows: no protein control, n=8; 10 mpk anti-βGal, n=8 (twice/week dosing); 4.6 mpk RSPO2, n=7 (twice/week dosing); 10 mpk anti-eGFP-mutRspo2, n=8 (daily dosing); 10 mpk αASGR1-RSPO2-RA-IgG2, n=8 (daily dosing). Additional control groups included no CCl4 treatment (olive oil carrier, 0.5 mL/kg), n=8; naïve control, n=7. Blood was drawn from mice on day 69, 72, 76 for INR (international normalized ratio) testing. All mice were terminated on day 83.

Effect of Tissue-Targeted RSPO Mimetics on Liver Function in a Chronic $CCl_4$-Induced Mouse Model of LIVER Fibrosis The activity and efficacy of αASGR1-RSPO2-RA-IgG was examined in a second mouse model of liver fibrosis generated with $CCl_4$ plus allyl alcohol. Fifty-four 8-9 week-old C57BL/6 males (Jackson Laboratories) were intermittently treated with $CCl_4$ (0.5 mL/kg at Day 1,4,7,10) plus allyl alcohol (0.0125 mL/kg at Day 2,5,8) for 10 days, followed by 8 weeks of $CCl_4$ treatment (0.5 mL/kg, twice/week). The treatment protocol is illustrated in FIG. 12. Following CCl4 treatment, mice were dosed with proteins for 2 weeks with discontinuous CCl4 treatment. Treatment groups are as follows: 10 mg/kg αASGR1-RSPO2-RA-IgG2, n=8 (daily dosing); 10 mg/kg αGFP-RSPO2-RA-IgG, n=8 (daily dosing); 4.6 mg/kg Fc-RSPO2-WT, n=7 (twice/week dosing); 10 mg/kg α-β-Gal-IgG, n=8 (twice/week dosing); no protein control, n=8. Additional control groups included no $CCl_4$ treatment (olive oil carrier (0.5 mL/kg), n=8; naïve control, n=7. Blood was drawn from mice on day 0, 3, 7 (first day of protein dosing denotes as Day 0) for INR (international normalised ratio) testing. All mice were terminated at Day 14.

Upon sacrifice, total body and liver weights were measured, blood, liver and small intestinal tissues were collected and preserved for testing. Liver weights showed an upward trend in groups treated with RSPO2 positive control as well as those treated with the RSPO mimetic, αASGR1-RSPO2-RA-IgG2. When liver/body weight ratios were measured, only RSPO2 treated mice had an increase that was statistically significant.

As a measure of tissue repair and fibrosis, procollagen type III N-terminal peptide (P3NP) was measured in the mouse blood on day 0, 7, and 14 of protein treatment. A significant increase was observed in all groups treated with $CCl_4$ as compared with olive oil treated and naive controls consistent with marked liver fibrosis. P3NP levels remained high in animals treated with the RSPO mimetic, αASGR1-RSPO2-RA-IgG2, indicating ongoing tissue repair and extracellular matix turnover, as compared with animals treated with αGFP-RSPO2-RA-IgG (lacking tissue targeting to the liver), where P3NP dropped back to the levels in naïve mice (data not shown).

After two weeks of protein treatment, the prothrombin time (PT) as a measure of blood clotting time indicated that no increase in time was seen, and the time actually significantly decreased in animal treated with the RSPO2 protein (data not shown).

At timepoints after one and two weeks of protein treatment, standard liver panel measurements were done in the serum. The mouse serum was collected from tail bleed at Day 7 and terminal bleed at Day 14. The sera were sent to IDEXX Laboratories (Fremont, Calif.) for liver panel serum chemistry measurement. Each group contained 6-8 mice and the data are presented in Table 4 and 5 as mean±SEM.

TABLE 4

Alanine Aminotransferase (ALT), Aspartate Aminotransferase (AST), and Alkaline Phosphatase (ALP) levels measured in blood in animals one and two weeks after protein treatments.

| Treatment group | ALT U/L +/− SEM | | AST U/L +/− SEM | | ALP U/L +/− SEM | |
|---|---|---|---|---|---|---|
| | wk 1 | wk 2 | wk 1 | wk 2 | wk 1 | wk 2 |
| Naïve | 24.0 +/− 1.9 | 32.0 +/− 2.6 | 44.6 +/− 2.4 | 41.5 +/− 4.1 | 68.6 +/− 4.1 | 55.5 +/− 3.9 |
| Oil control | 22.8 +/− 0.9 | 30.8 +/− 4.2 | 43.0 +/− 1.7 | 53.8 +/− 9.7 | 78.1 +/− 4.7 | 65.6 +/− 3.1 |
| No protein in $CCl_4$ mice | 33.2 +/− 1.0 | 36.4 +/− 2.5 | 53.6 +/− 3.9 | 54.8 +/− 4.0 | 108.6 +/− 3.5 | 87.8 +/− 4.1 |
| α-β-Gal-IgG in $CCl_4$ mice | 28.7 +/− 1.7 | 33.9 +/− 3.3 | 48.3 +/− 3.5 | 68.9 +/− 17.5 | 113.3 +/− 7.1 | 102.9 +/− 4.3 |
| Fc-RSPO2-WT in $CCl_4$ mice | 51.7 +/− 14.4 | 42.1 +/− 5.1 | 83.0 +/− 14.0 | 74.4 +/− 9.8 | 83.0 +/− 8.5 | 28.4 +/− 5.2 |
| α-GFP-RSPO2-RA-IgG in $CCl_4$ mice | 27.9 +/− 1.2 | 36.4 +/− 5.7 | 52.9 +/− 4.6 | 69.0 +/− 13.3 | 117.9 +/− 9.4 | 70.3 +/− 2.5 |
| αASGR1-RSPO2-RA-IgG2 in $CCl_4$ mice | 59.4 +/− 27.7 | 57.9 +/− 18.7 | 85.6 +/− 33.0 | 98.1 +/− 20.2 | *411.4 +/− 63.9 | **164.9 +/− 24.0 |

*Statistically different from α-β-Gal-IgG and αGFP-RSPO2-RA-IgG treated groups, p < 0.0001;
**Statistically different from α-β-Gal-IgG (p = 0.0012) and αGFP-RSPO2-RA-IgG (p < 0.0001) treated groups; One-way ANOVA.

As shown in Table 4, ALT and AST values were not statistically different with any of the protein treatments and controls. ALP, however, was statically higher at both one-week and two-week timepoints, consistent with the upregulation of the alkaline phosphatase protein levels due to the elimination of ASGR receptor as described in an ASGR1 KO mouse model (see, e.g., *Cell Host Microbe.* 2018 Oct. 10; 24(4):500-513).

TABLE 5

Albumin, and billirubin levels measured in the blood of animals one and two weeks after protein treatments.

| Treatment group | Albumin g/dL +/− SEM | | Billirubin mg/dL +/− SEM | |
|---|---|---|---|---|
| | wk 1 | wk 2 | wk 1 | wk 2 |
| Naïve | 3.1 +/− 0.2 | 2.9 +/− 0.0 | 0.2 +/− 0.0 | 0.1 +/− 0.0 |
| Oil control | 3.2 +/− 0.1 | 2.8 +/− 0.0 | 0.2 +/− 0.0 | 0.2 +/− 0.0 |
| no protein in CCl$_4$ mice | 3.5 +/− 0.1 | 2.8 +/− 0.0 | 0.2 +/− 0.0 | 0.2 +/− 0.0 |
| α-β-Gal-IgG in CCl$_4$ mice | 3.2 +/− 0.2 | 2.8 +/− 0.0 | 0.2 +/− 0.0 | 0.2 +/− 0.0 |
| Fc-RSPO2-WT in CCl$_4$ mice | 2.6 +/− 0.1 | *1.6 +/− 0.1 | 0.2 +/− 0.0 | 0.1 +/− 0.0 |
| α-GFP-RSPO2-RA-IgG in CCl$_4$ mice | 3.0 +/− 0.1 | 2.5 +/− 0.0 | 0.2 +/− 0.0 | 0.2 +/− 0.0 |
| αASGR1-RSPO2-RA-IgG2 in CCl$_4$ mice | 2.5 +/− 0.1 | *2.2 +/− 0.1 | 0.2 +/− 0.0 | 0.2 +/− 0.0 |

*Statistically different from α-β-Gal-IgG treated groups, p < 0.0001 for Fc-RSPO2-WT and p = 0.0009 for αASGR1-RSPO2-RA-IgG2;
**Statistically different from α-β-Gal-IgG (p < 0.0001) and α-GFP-RSPO2_RA-IgG (p < 0.0009) treated groups; One-way ANOVA.

While there was no significant effect on albumin, billirubin, levels one week after treatment, significantly less albumin in blood was observed after two weeks of protein treatment in both the RSPO2 positive control and RSPO mimetic (αASGR1-RSPO2-RA-IgG2) treatment groups as compared with α-β-Gal-IgG and α-GFP-RSPO2 RA-IgG protein controls. This result suggests an expected temporary shut down in function of periportal hepatocytes due to increased pericentral hepatocyte expansion, induced by increased Wnt signaling.

Semi-quantitative PCR was used to measure changes in gene expression in liver and small intestine with protein treatments (Table 6).

TABLE 6

Changes in expression of Wnt-inducible genes and proliferation marker genes in liver and small intestine as measured by qPCR

| Treatment group | Liver | | | | Small intestine | | |
|---|---|---|---|---|---|---|---|
| | Axin2 | Hal | Ki67 | Cyclin D1 | Axin2 | Ki67 | Cyclin D1 |
| Naïve | 1.0 +/− 0.1 | 1.0 +/− 0.00 | 1.0 +/− 0.1 | 1.0 +/− 0.1 | 1.0 +/− 0.1 | 1.0 +/− 0.1 | 1.0 +/− 0.2 |
| Oil control | 0.7 +/− 0.1 | 0.8 +/− 0.0 | 0.6 +/− 0.1 | 1.1 +/− 0.1 | 0.7 +/− 0.0 | 0.7 +/− 0.1 | 0.7 +/− 0.1 |
| no protein in CCl$_4$ mice | 1.0 +/− 0.1 | 1.0 +/− 0.1 | 2.3 +/− 0.4 | 2.0 +/− 0.3 | 0.8 +/− 0.1 | 0.9 +/− 0.1 | 0.6 +/− 0.1 |
| α-βGal-IgG in CCl$_4$ mice | 2.2 +/− 0.2 | 1.0 +/− 0.1 | 2.8 +/− 0.4 | 2.8 +/− 0.4 | 1.0 +/− 0.1 | 0.6 +/− 0.1 | 1.4 +/− 0.3 |
| Fc-RSPO2-WT in CCl$_4$ mice | 3.3 +/− 0.8 | 0.4 +/− 0.2 | 13.8 +/− 3.3 | 14.1 +/− 4.4 | 1.8 +/− 0.7 | 0.5 +/− 0.2 | 0.6 +/− 0.2 |
| αGFP-RSPO2-RA-IgG in CCl$_4$ mice | 1.8 +/− 0.2 | 1.0 +/− 0.1 | 7.2 +/− 0.9 | 3.6 +/− 0.5 | 0.6 +/− 0.1 | 0.7 +/− 0.0 | 0.4 +/− 0.1 |
| αASGR1-RSPO2-RA-IgG2 in CCl$_4$ mice | 4.2 +/− 1.0 | 0.4 +/− 0.1 | 11.4 +/− 3.2 | 6.3 +/− 1.8 | 0.6 +/− 0.1 | 0.6 +/− 0.0 | 0.8 +/− 0.2 |

* Statistically different changes shown in bold.
Axin2: αASGR1-RSPO2-RA-IgG2 vs α-GFP-RSPO2-RA-IgG, p = 0.0092.
Hal: Fc-RSPO2-WT vs. α-βGal-IgG, p = 0.0259; αASGR1-RSPO2-RA-IgG2 vs α--Gal-IgG, p = 0.0042; αASGR1-RSPO2-RA-IgG2 vs α-GFP-RSPO2-RA-IgG, p = 0.0018.
Ki67: Fc-RSPO2-WT vs. α-βGal-IgG, p = 0.0010; αASGR1-RSPO2-RA-IgG2 vs α-βGal-IgG, p = 0.0135.
Cyclin D1: FcRSPO2-WT vs. α-βGal-IgG, p = 0.0004.
Calculated by one-way ANOVA.

Treatment of mice with Fc-RSPO2-WT positive control protein or RPSO mimetic protein, αASGR1-RSPO2-RA-IgG2, both lead to increased expression of the Wnt-inducible Axin2 gene and decreased expression of the Wnt-repressable Hal gene in liver. Measured changes that were statistically significant are shown in bold in Table 6. There was no significant change in Axin2 expression in small intestine. These data indicate that Wnt signaling was induced in a tissue-specific manner.

Treatment with Fc-RPSO2-WT and αASGR1-RSPO2-RA-IgG2 also revealed increases in Ki67 and Cyclin D1 proliferation markers in the liver but not in small intestine. Changes that reached statistical significance are shown in bold. No significant changes were seen in small intestine with any treatment (Table 6). These data show that proliferation was induced in a tissue-specific manner Additional qPCR analysis was done to measure changes in specific liver cell types, including hepatocytes, cholangiocytes, immature hepatocytes, and oval cells (Table 7).

TABLE 7

Changes in expression of genes used as markers for liver cell types with protein treatment as measured by qPCR

| Treatment group | hepatocytes CK8 | Cholangiocytes CK19 | Immature hepatocytes Afp | Chloangiocytes/ Oval cells Sox9 |
|---|---|---|---|---|
| Naïve | 1.0 +/− 0.1 | 1.0 +/− 0.1 | 1.0 +/− 0.1 | 1.0 +/− 0.1 |
| Oil control | 0.8 +/− 0.0 | 0.9 +/− 0.1 | 1.1 +/− 0.1 | 0.8 +/− 0.1 |
| no protein in CCl$_4$ mice | 0.9 +/− 0.1 | 1.4 +/− 0.1 | 1.3 +/− 0.2 | 1.2 +/− 0.1 |
| α-βGal-IgG in CCl$_4$ mice | 0.7 +/− 0.1 | 1.0 +/− 0.1 | 1.3 +/− 0.1 | 1.5 +/− 0.1 |
| Fc-RSPO2-WT in CCl$_4$ mice | *1.4 +/− 0.3 | 0.7 +/− 0.1 | *3.5 +/− 0.3 | 1.3 +/− 0.1 |
| αGFP-RSPO2-RA-IgG in CCl$_4$ mice | 0.6 +/− 0.0 | 1.0 +/− 0.1 | 1.6 +/− 0.1 | 1.2 +/− 0.1 |
| αASGR1-RSPO2-RA-IgG2 in CCl$_4$ mice | *1.8 +/− 0.2 | 1.5 +/− 0.2 | *3.7 +/− 0.7 | 1.0 +/− 0.1 |

*Statistically different changes shown in bold.
CK8: αASGR1-RSPO2-RA-IgG2 vs α-βGal-IgG, p = 0.0001; αASGR1-RSPO2-RA-IgG2 vs α-GFP-RSPO2-RA-IgG, p < 0.0001. Afp: Fc-RSPO2-WT vs. α-βGal-IgG, p = 0.0002; αASGR1-RSPO2-RA-IgG2 vs α-βGal-IgG, p < 0.0001; αASGR1-RSPO2-RA-IgG2 vs α-GFP-RSPO2-RA-IgG, p = 0.0001. Calculated by one-way ANOVA.

Assessment of statistically significant changes in the hepatocyte marker, CK8 but not cholangiocyte marker, CK19 indicates that proliferative response in the liver is confined to hepatocytes. Moreover, a statistically significant increase in Afp reveals a surge of immature hepatocytes (Table 7). There was no significant change in oval cells.

TABLE 8

Changes in expression of genes related to function of hepatocytes and periportal hepatocytes with protein treatment as measured by semi-quantitative PCR

| Treatment group | Hepatocyte function Factor X | Pericental hepatocyte function Cyp1a2 | Pericentral hepatocyte function Cyp2e1 | Periportal hepatocyte function Cyp2f2 |
|---|---|---|---|---|
| Naïve | 1.0 +/− 0.1 | 1.0 +/− 0.1 | 1.0 +/− 0.1 | 1.0 +/− 0.2 |
| Oil control | 0.9 +/− 0.1 | 0.9 +/− 0.1 | 0.9 +/− 1.2 | 0.8 +/− 0.1 |
| no protein in CCl$_4$ mice | 1.1 +/− 0.1 | 0.6 +/− 0.0 | 1.0 +/− 0.1 | 1.2 +/− 0.1 |
| α-βGal-IgG in CCl$_4$ mice | 1.2 +/− 0.1 | 0.8 +/− 0.1 | 1.0 +/− 0.1 | 0.8 +/− 0.1 |
| Fc-RSPO2-WT in CCl$_4$ mice | *1.9 +/− 0.3 | 0.7 +/− 0.3 | 1.2 +/− 0.2 | *0.1 +/− 0.0 |
| αGFP-RSPO2-RA-IgG in CCl$_4$ mice | 1.0 +/− 0.2 | 0.5 +/− 0.1 | 0.8 +/− 0.1 | 0.8 +/− 0.0 |
| αASGR1-RSPO2-RA-IgG2 in CCl$_4$ mice | 1.2 +/− 0.1 | *2.0 +/− 0.4 | *2.7 +/− 0.5 | *0.1 +/− 0.0 |

*Statistically different changes shown in bold.
Factor X: Fc-RSPO2-WT vs. α-β-Gal-IgG, p = 0.0463. Cyp1a2: αASGR1-RSPO2-RA-IgG2 vs α-βGal-IgG, p = 0.0044; αASGR1-RSPO2-RA-IgG2 vs αGFP-RSPO2-RA-IgG, p = 0.0001. Cyp2e1: αASGR1-RSPO2-RA-IgG2 vs α-β-Gal-IgG, p < 0.0001; αASGR1-RSPO2-RA-IgG2 vs αGFP-RSPO2-RA-IgG, p < 0.0001. Cyp2f2: Fc RSPO2-WT vs α-βGal-IgG, p < 0.0001; αASGR1-RSPO2-RA-IgG2 vs α-βGal-IgG, p < 0.0001; αASGR1-RSPO2-RA-IgG2 vs αGFP-RSPO2-RA-IgG, p < 0.0001. Calculated by one-way ANOVA.

Wnt signaling controls the expression of two CypP450 enzymes, Cyp2e1 and Cyp1a2 predominantly in pericentral hepatocytes (ref). Treatment of mice with the RSPO mimetic significantly increased the expression of the genes for these two enzymes (Table xx). In addition, significantly lower Cyp2f2 indicates a temporary reduction in periportal hepatocyte function due to temporary expansion of pericentral zone.

Figure 13:
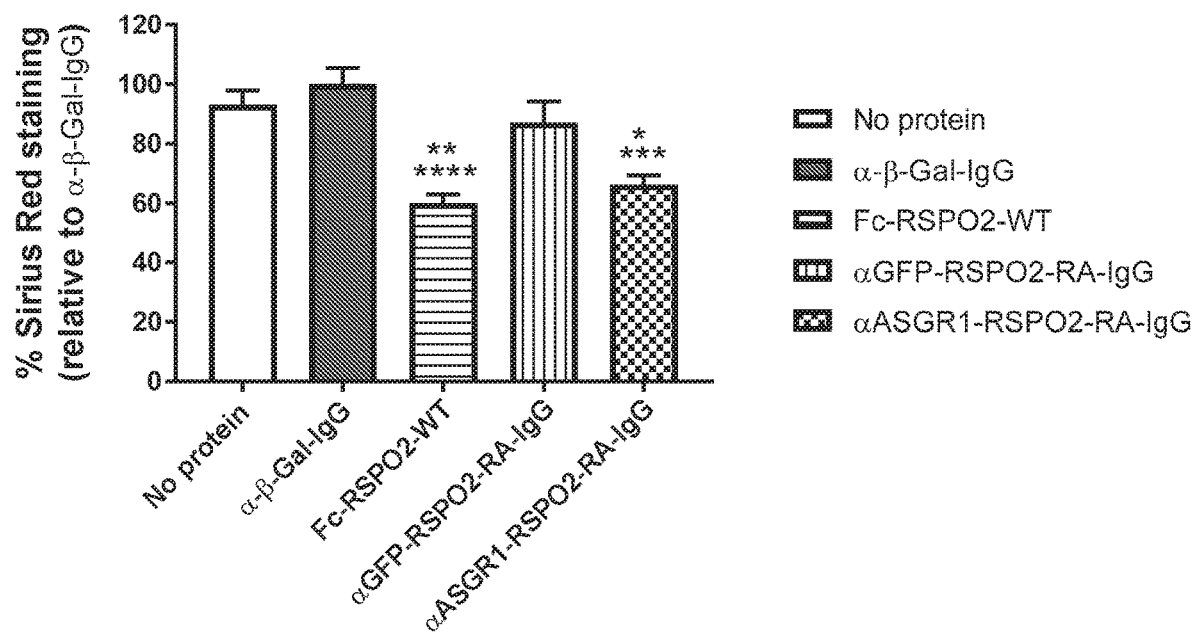
FIG. 13 Percent Sirius red staining of various treatment groups of CCl4-induced fibrosis model.
Figure 14B:
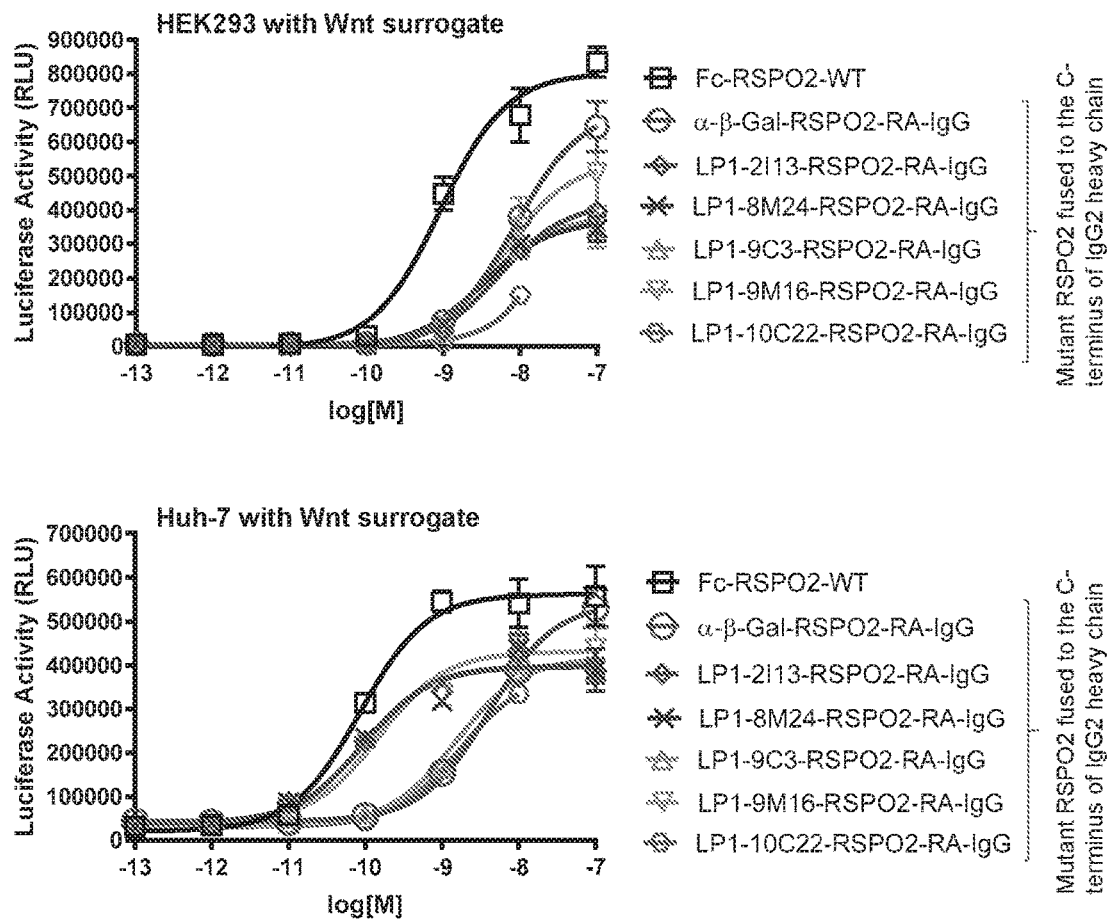
Figure 14D:
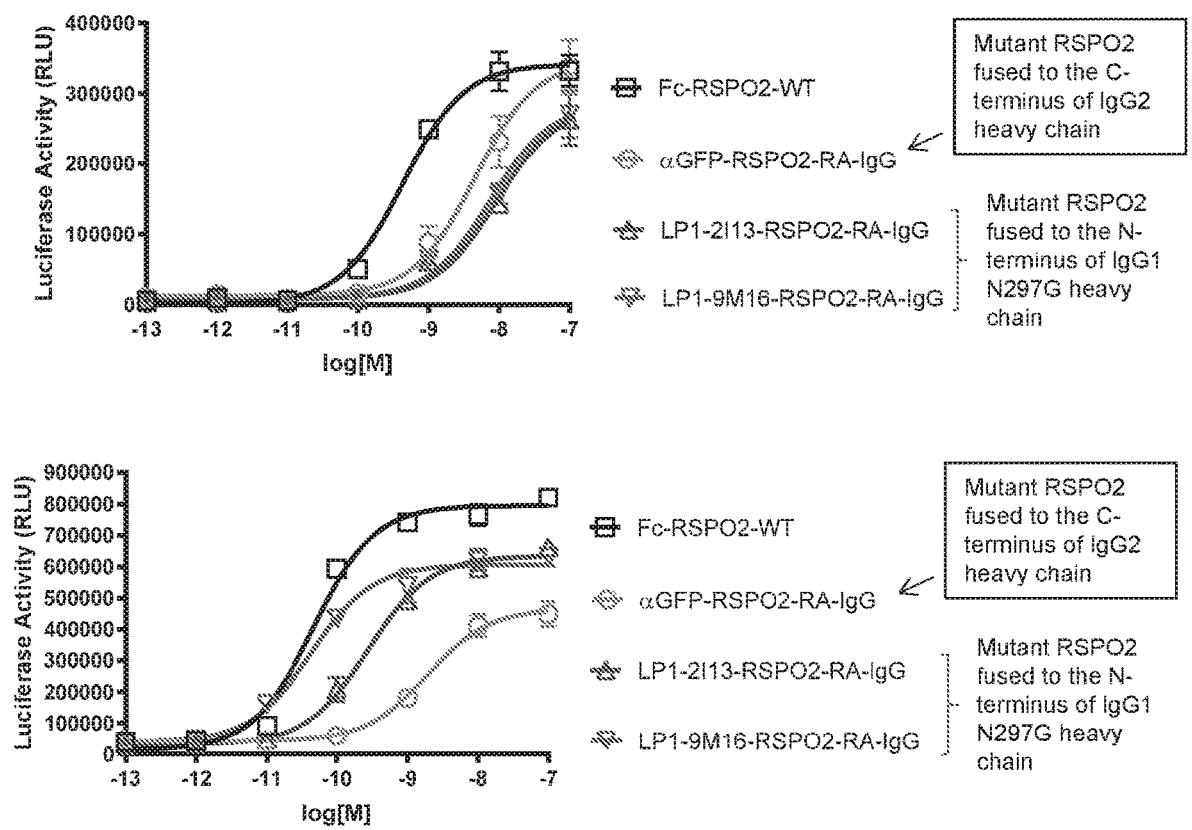

After two weeks of protein treatment, mouse livers were stained with Sirius red to measure the levels of the Sirius red staining collagen content in all the mice (FIG. 13 and Table 9). Mice were anesthetized by isoflurane inhalation, cardiac bleed and followed by cervical dislocation. The livers were freshly harvested and immediately immersed into 10% neutral buffered formalin for overnight incubation. Next day, the livers were transferred to 70% ethanol and prepared for paraffin embedding. The liver tissues were cut into 5 μm thickness, de-wax and hydrated by alcohol gradient. The slides were stained with Picro-sirius red solution (Sigma-Aldrich) and wash with acidified water. Dehydrate in three changes of 100% ethanol, clear in xylene, air dry and mount with cover slip. The Sirius red stained area was quantitated by Image J (NIH) and normalized with liver from anti-βgal control treated $CCl_4$ mice (set as 100%). Each group contained 7-8 mice and the data are presented as mean±SD.

TABLE 9

Quantification of Sirius Red staining of liver tissue normalized to anti-βGal treated $CCl_4$ mice

| Treatment group | Percent Sirius Red (relative to βGal) |
|---|---|
| no protein in $CCl_4$ mice | 93.0 +/− 4.8 |
| α-β-Gal-IgG in $CCl_4$ mice | 100 +/− 5.4 |
| Fc-RSPO2-WT in $CCl_4$ mice | *60.0 +/− 2.9 |
| αGFP-RSPO2-RA-IgG in $CCl_4$ mice | 87.0 +/− 7.1 |
| αASGR1-RSPO2-RA-IgG2 in $CCl_4$ mice | *66.3 +/− 3.2 |

*Statistically different changes shown in bold.
Fc-RSPO2-WT vs. α-β-Gal-IgG, p < 0.0001; Fc-RSPO2-WT vs αGFP-RSPO2-RA-IgG, p = 0.0059; α-ASGR1-RSPO2-RA-IgG2 vs α-β-Gal-IgG, p = 0.0003; α-ASGR1-RSPO2-RA-IgG2 vs αGFP-RSPO2-RA-IgG, p = 0.0410; Calculated by one-way ANOVA.

After treatment, Sirius red staining was used to quantify the amount of liver fibrosis in all mice in this study. For this method, the mouse was anesthetized by isoflurane inhalation, cardiac bleed and followed by cervical dislocation. The livers were freshly harvested and immediately immersed into 10% neutral buffered formalin for overnight incubation. Next day, the livers were transferred to 70% ethanol and prepared for paraffin embedding. The liver tissues were cut into 5 μm thickness, de-wax and hydrated by alcohol gradient. The slides were stained with Picro-sirius red solution (Sigma-Aldrich) and wash with acidified water. Dehydrate in three changes of 100% ethanol, clear in xylene, air dry and mount with cover slip. The Sirius red stained area was quantitated by Image J (NIH) and normalized with liver from α-β-Gal-IgG control treated $CCl_4$ mice (set as 100%). Each group contained 7-8 mice and the data are presented as mean±SD.

After two weeks of treatment with Fc-RSPO2-WT or RPSO mimetic, αASGR1-RSPO2-RA-IgG2, CCl4-treated mice had a ~40% reduction in Sirius Red staining than that seen in mice treated with control proteins, indicating that liver fibrosis was resoving in these mice faster than in mice treated with control proteins (FIG. 13 and Table 9)

Additional experiments were done with immunohistochemistry, staining for HNF4α and Ki67 on paraffin fixed liver tissue from all animals in this study. In both Fc-RSPO2-WT and αASGR1-RSPO2-RA-IgG2 treated mice, significant colocalization of the HNF4a hepatocyte marker and the Ki67 proliferation marker was seen throughout the liver (data no shown). In contrast, far fewer double stained cells were seen in α-β-Gal-IgG treated control mice. These results confirmed that Fc-RSPO2-WT and αASGR1-RSPO2-RA-IgG2 can induce hepatocyte proliferationin these mice.

Together these data suggest that the RSPO mimetic, αASGR1-RSPO2-RA-IgG2, has a significant impact on the rate at which mice in this model of fibrotic liver desease can resolve fibrosis and regenerate functional hepatocytes.

Example 7

Construction of Liver-Targeted RSPO Mimetic Molecules Using Novel ASGR1Binders

Novel binders to human ASGR1 were developed as hybridomas which were raised against human ASGR1 and selected based on cross-reactivity to recombinant human and cynomolgus ASGR1 ECD domains. The hybridomas were further ranked for specific staining of Huh-7 cells (using HEK293 as controls) by flow cytometry. Selected hits were subcloned and sequenced to deduce their VH and VL sequences (SEQ ID NOs: 274-305). To make liver-specific RSPO mimetics, fusion proteins were made, with ASGR1 binders expressed as human IgG2 or human IgG1 containing the effectorless mutation N297G, while the mutant RSPO module was fused to the N- or C-terminus of the heavy chain via a linker (SEQ ID NOs: 190-271). Recombinant proteins were expressed in Expi293 cells by transient transfection and purified by Protein A resin followed by size exclusion chromatography. Hepatocyte specific Wnt signal enhancement were analyzed in luciferase assay comparing the activity in Huh-7 and HEK293 STF reporter cell lines in the presence of a recombinant WNT surrogate R2M3-26 (see, e.g., WO2019/126398). FIG. 12 demonstrates specific activity of 16 novel ASGR1 targeted RSPO-mimetic molecules in Huh-7 cells, as IgG1 or IgG2 fusions.

Example 8

Pharmacodynamic (PD)Analysis of Tissue-Targeted RSPO Mimetics in Mouse Liver

In order to measure the in vivo activity of liver-targeted RSPO mimetics, 5-6 wks old C57BL/6 males JAX (56 mice total) were humanized for human ASGR gene expression. Mice were injected (IV) mice with AAV8 vectors expressing hASGR1 and hASGR2 genes ($1\times10^{11}$ genome copies/mouse).

Figures 15A, 15B:
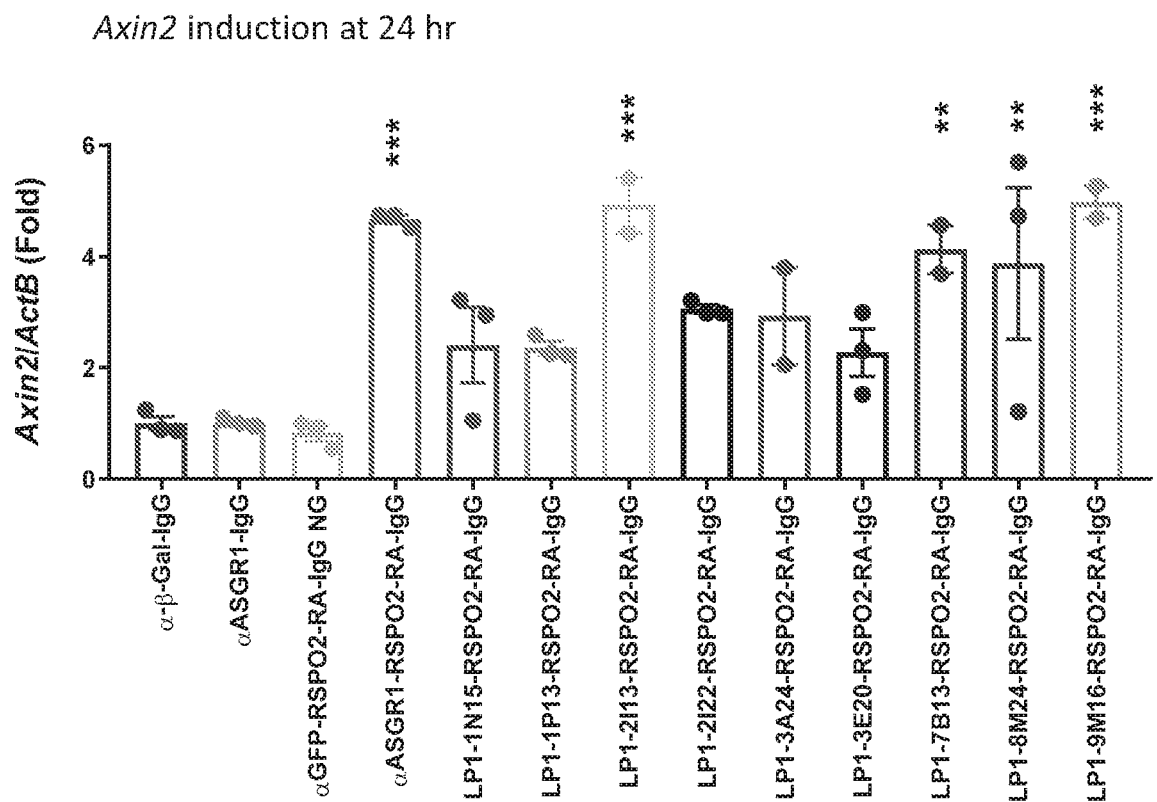
FIG. 15. Wnt-response gene, liver Axin2, induction by RSPO mimetic molecules derived from invernal hybridoma binders. Mice were injected with 1×10$^{11}$ genomic particles of AAV-TBG-hASGR1 and AAV-TBG-hASGR2 respectively, five days prior to protein dosing. Liver samples were collected 24 hours after protein dosing and processed for semi-quantitative PCR analysis. (A) Sequence ID numbers, name, dose and number of mice used in the study. (B) Liver expression of Axin2, after i.p. injection. Statistical analysis was performed using 1-way ANOVA: () p<0.01, (*) p<0.001

After 6 days, multiple ASGR1-targeted RSPO mimetics, together with controls, were administered to mice via i.p. injection at 5 mg/kg dosage (FIG. 15A).

After 24 hours, mice were euthanized; livers were dissected out and snap frozen for RNA isolation. mRNA analysis was done to determine the relative expression of Axing. Semi-quantitative PCR was used to measure the relative gene expression in liver tissue from treated mice. Values were normalized to expression of constitutive Actin B gene expression (FIG. 15B).

As compared with α-β-Gal-IgG, αASGR1-IgG (RO-01) did not induce Axin2 expression, suggesting this binder has no effect by itself on Wnt signaling. Similarly, αGFP-RSPO2-RA-IgG did not induce Axin2, confirming that the mutant RSPO2 module by itself has no activity either. In contrast, αASGR1-RSPO2-RA-IgG (the prototypical liver-targeted RSPO mimetic constructed with binder RO-01), demonstrated potent Axin2 inductin in liver, consistent with the requirement of the targeting module.

All the additional ASGR1-targeted RSPO mimetic molecules (constructed with in-house rased binders) showed either a trend or significant induction of Axin2 expression. 7B13, 8M24, 2113, and 9M16-based RSPO mimetic molecules showed statistically significant increase in stimulating Axin2 expression as compared to α-β-Gal-IgG control by one-way ANOVA, while 3A24, 2122, 1P13, 1N15, 3E20 showed a trend in stimulating Axin2 expression (FIG. 15B).

The various embodiments described above can be combined to provide further embodiments. All of the U.S. patents, U.S. patent application publications, U.S. patent application, foreign patents, foreign patent application and non-patent publications referred to in this specification and/or listed in the Application Data Sheet are incorporated herein by reference, in their entirety. Aspects of the embodiments can be modified, if necessary to employ concepts of the various patents, application and publications to provide yet further embodiments. These and other changes can be made to the embodiments in light of the above-detailed description. In general, in the following claims, the terms used should not be construed to limit the claims to the specific embodiments disclosed in the specification and the claims, but should be construed to include all possible embodiments along with the full scope of equivalents to which such claims are entitled. Accordingly, the claims are not limited by the disclosure.

REFERENCES

Clevers H, Loh K M and Nusse R. 2014, An integral program for tissue renewal and regeneration: Wnt signaling and stem cell control. Science 346(6205): 1248012.

Yan J J, Liao J Z, Lin J S and He X X. 2015, Active radar guides missile to its target: receptor-based targeted treatment of hepatocellular carcinoma by nanoparticulate systems. Tumor Biology 36: 55-67.

Stockert R J, Morell A G and Ashwell G. 1991, Structural characteristics and regulation of the asialoglycoprotein receptor. Targeted Diagnostic and Therapy 4: 41-64.

D'Souza A A and Devarajan P V. 2015, Asialoglycoprotein receptor mediated hepatocyte targeting—strategies and applications. Journal of Controlled Release, 203: 126-139.

Janda C Y, Dang L T, You C, Chang J, de Lau W, Zhong Z A, Yan K S, Marecic O, Siepe D, Li X, Moody J D, Williams B O, Clevers H, Piehler J, Baker D, Kuo C J, and Garcia K C. 2017, Surrogate Wnt agonists that phenocopy canonical Wnt and β-catenin signaling. Nature 545: 234-237.

SEQUENCE LISTING (715 sequences)

SEQ ID NO: 1 - protein, 263 aa, Homo sapiens
MRLGLCVVALVLSWTHLTISSRGIKGKRQRRISAEGSQACAKGCELCSEVNGCLKCSPKLFILLERNDIRQVGVCLPSCPPGYFDARNPDMNKCIKCKIEHCEACFSHNFCTKCKEGLYLHKGRCYPACPEGSSAANGTMECSSPAQCEMSEWSPWGPCSKKQQLCGFRRGSEERTRRVLHAPVGDHAACSDTKETRRCTVRRVPCPEGQKRRKGGQGRRENANRNLARKESKEAGAGSRRRKGQQQQQQQGTVGPLTSAGPA

SEQ ID NO: 2 - protein, 243 aa, Homo sapiens
MQFRLFSFALIILNCMDYSHCQGNRWRRSKRASYVSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGCEVGHWSEWGTCSRNNRTCGFKWGLETRTRQIVKKPVKDTILCPTIAESRRCKMTMRHCPGGKRTPKAKEKRNKKKKRKLIERAQEQHSVFLATDRANQ

SEQ ID NO: 3 - protein, 272 aa, Homo sapiens
MHLRLISWLFIILNFMEYIGSQNASRGRRQRRMHPNVSQGCQGGCATCSDYNGCLSCKPRLFFALERIGMKQIGVCLSSCPSGYYGTRYPDINKCTKCKADCDTCFNKNFCTKCKSGFYLHLGKCLDNCPEGLEANNHTMECVSIVHCEVSEWNPWSPCTKKGKTCGFKRGTETRVREIIQHPSAKGNLCPPTNETRKCTVQRKKCQKGERGKKGRERKRKKPNKGESKEAIPDSKSLESSKEIPEQRENKQQQKKRKVQDKQKSVSVSTVH

SEQ ID NO: 4 - protein, 234 aa, Homo sapiens
MRAPLCLLLLVAHAVDMLALNRRKKQVGTGLGGNCTGCIICSEENGCSTCQQRLFLFIRREGIRQYGKCLHDCPPGYFGIRGQEVNRCKKCGATCESCFSQDFCIRCKRQFYLYKGKCLPTCPPGTLAHQNTRECQGECELGPWGGWSPCTHNGKTCGSAWGLESRVREAGRAGHEEAATCQVLSESRKCPIQRPCPGERSPGQKKGRKDRRPRKDRKLDRRLDVRPRQPGLQP

SEQ ID NO: 5 - DNA, 1119 bp, Artificial Sequence
  Made in Lab: anti-GFP and RSPO2 wild type fusion sequence
caggtccagttggtggaatccggagggggtttggtccagcctggtggaagcctgcgcctctcatgcgccgctagcggattcaccttctcccgatacggcatgcattgggtcagacaggcacccggaaaaggactcgaatgggtgtcgggcatttcctcgatcgggtcaaacacctattacgccgactccgtgaagggacggttcaccattagccgggataacagcaagaacactctgtacttgcaaatgaactccctgcgggctgaggacaccgccgtgtactactgtgcgcggtggtacaagacctatattgacgtctggggacagggtaccctcgtgaccgtgtcatccggtggtggaggatccggaggcggaggaagcggaggagggggttcagacatcgaactcacccagcccccgtcagtgtccgtggcccctggacagactgcgcgcatctcctgctccggcgacaacctggggaagaaatacgtgtactggtaccagcagaagccaggtcaagcccctgtgctggtcatctacggcgacgacgaaaggccgtcaggcatcccagagcgcttctccggctccaactccgggaatactgccacccttaccatttccggaacccaggccgaggatgaagcggattactattgcgcgagctacgatagcagccacatcctgatcgtgtttggaggcggtactaagctgaccgtgctgggaagcggtggatcaaacccaatttgcaagggatgcctgagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgcttcagcaaggacttctgcactaagtgcaaagtcggcttctaccttcaccggggcagatgttttgacgaatgcccggatggcttcgccccgctggaggagactatggaatgcgtggagggcggagactacaaggacgacgatgacaagggctcccaccatcaccaccatcatcaccactag

SEQ ID NO: 6 - protein, 372 aa, Artificial Sequence
  Made in Lab: anti-GFP and RSPO2 wild type fusion sequence
QVQLVESGGGLVQPGGSLRLSCAASGFTFSRYGMHWVRQAPGKGLEWVSGISSIGSNTYYADSVKGRFTISRDNSKNTLYLQMNSLRAEDTAVYYCARWYKTYIDVWGQGTLVTVSSGGGGSGGGGSGGGGSDIELTQPPSVSVAPGQTARISCSGDNLGKKYVYWYQQKPGQAPVLVIYGDDERPSGIPERFSGSNSGNTATLTISGTQAEDEADYYCASYDSSHILIVFGGGTKLTVLGSGGSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGGDYKDDDDKGSHHHHHHHH

SEQ ID NO: 7 - DNA, 1119 bp, Artificial Sequence
  Made in Lab: anti-GFP and RSPO2 mutant fusion sequence
caggtccagttggtggaatccggagggggtttggtccagcctggtggaagcctgcgcctctcatgcgccgctagcggattcaccttctcccgatacggcatgcattgggtcagacaggcacccggaaaaggactcgaatgggtgtcgggcatttcctcgatcgggtcaaacacctattacgccgactccgtgaagggacggttcaccattagccgggataacagcaagaacactctgtacttgcaaatgaactccctgcgggctgaggacaccgccgtgtactactgtgcgcggtggtacaagacctatattgacgtctggggacagggtaccctcgtgaccgtgtcatccggtggtggaggatccggaggcggaggaagcggaggagggggttcagacatcgaactcacccagcccccgtcagtgtccgtggcccctggacagactgcgcgcatctcctgctccggcgacaacctggggaagaaatacgtgtactggtaccagcagaagccaggtcaagcccctgtgctggtcatctacggcgacgacgaaaggccgtcaggcatcccagagcgcttctccggctccaactccgggaatactgccacccttaccatttccggaacccaggccgaggatgaagcggattactattgcgcgagctacgatagcagccacatcctgatcgtgtttggaggcggtactaagctgaccgtgctgggaagcggtggatcaaacccaatttgcaagggatgcctgagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggcggagactacaaggacgacgatgacaagggctcccaccatcaccaccatcatcaccactag

SEQ ID NO: 8 - protein, 372 aa, Artificial Sequence
  Made in Lab: anti-GFP and RSPO2 mutant fusion sequence
QVQLVESGGGLVQPGGSLRLSCAASGFTFSRYGMHWVRQAPGKGLEWVSGISSIGSNTYYADSVKGRFTISRDNSKNTLYLQMNSLRAEDTAVYYCARWYKTYIDVWGQGTLVTVSSGGGGSGGGGSGGGGSDIELTQPPSVSVAPGQTARISCSGDNLGKKYVYWYQQKPGQAPVLVIYGDDERPSGIPERFSGSNSGNTATLTISGTQAEDEADYYCASYDSSHILIVFGGGTKLTVLGSGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGDYKDDDDKGSHHHHHHHH

SEQ ID NO: 9 - DNA, 1119 bp, Artificial Sequence
  Made in Lab: anti-GFP and RSPO2 mutant fusion sequence
caggtccagttggtggaatccggagggggtttggtccagcctggtggaagcctgcgcctctcatgcgccgctagcggattcaccttctcccgatacggcatgcattgggtcagacaggcacccggaaaaggactcgaatgggtgtcgggcatttcctcgatcgggtcaaacacctattacgccgactccgtgaagggacggttcaccattagccgggataacagcaagaacactctgtacttgcaaatgaactccctgcgggctgaggacaccgccgtgtactactgtgcgcggtggtacaagacctatattgacgtctggggacagggtaccctcgtgaccgtgtcatccggtggtggaggatccggaggcggaggaagcggaggagggggttcagacatcgaactcacccagcccccgtcagtgtccgtggcccctggacagactgcgcgcatctcctgctccggcgacaacctggggaagaaatacgtgtactggtaccagcagaagccaggtcaagcccctgtgctggtcatctacggcgacgacgaaaggccgtcaggcatcccagagcgcttctccggctccaactccgggaatactgccacccttaccatttccggaacccaggccgaggatgaagcggattactattgcgcgagctacgatagcagccacatcctgatcgtgtttggaggcggtactaagctgaccgtgctgggaagcggtggatcaaacccaatttgcaagggatgcctgagctgtagcaaggacaacggatgttcacggtgccagcaaaagctgtttttcttcctccgggccgaaggaatggccgcatacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggcggagactacaaggacgacgatgacaagggctcccaccatcaccaccatcatcaccactag

SEQ ID NO: 10 - protein, 372 aa, Artificial Sequence
  Made in Lab: anti-GFP and RSPO2 mutant fusion sequence
QVQLVESGGGLVQPGGSLRLSCAASGFTFSRYGMHWVRQAPGKGLEWVSGISSIGSNTYYADSVKGRFTISRDNSKNTLYLQMNSLRAEDTAVYYCARWYKTYIDVWGQGTLVTVSSGGGGSGGGGSGGGGSDIELTQPPSVSVAPGQTARISCSGDNLGKKYVYWYQQKPGQAPVLVIYGDDERPSGIPERFSGSNSGNTATLTISGTQAEDEADYYCASYDSSHILIVFGGGTKLTVLGSGGSNPICKGCLSCSKDNGCSRCQQKLFFFLRAEGMAAYGECLHSCPSGYYGHRAPDMNRCARCRIENCDSCRSKDACTKCKVGFYLHRGRCFDECPDGFAPLEETMECVEGGDYKDDDDKGSHHHHHHHH

SEQ ID NO: 11 - DNA, 1125 bp, Artificial Sequence
  Made in Lab: anti-ASGR1 and RSPO2 wild type fusion sequence
gaagtgcagctgctggaatccgggggcggactggtgcaacccgggggatccctcagactgtcctgtgccgcatcgggtttcactttctcctcctacgcgatgtcatgggtcagacaggcccctggaaaaggcctcgaatgggtgtcggctatctccggatcggggggatctacttactacgccgactccgtgaagggccggttcactatctcgagggacaactccaagaataccctgtacttgcaaatgaactccctgcgcgccgaggataccgcggtgtattactgcgccaaggacttcagctcacgccggtggtaccttgagtactggggacagggaacccttgtcaccgtgtccagcggtggcggcggaagcggcgggggcggatccggtggcgggggctcagagctcacccaggaccccgctgtgtccgtggccttgggacagaccgtgcgcatcacatgccagggcgatagcctgcggagctattacgcctcgtggtaccagcagaagcctggtcaagcgccggtcctggtcatctacggaaagaacaaccgcccgtccggaattccagacaggttcagcggatccagctcggggaacaccgcctcactgactatcaccggagcacaggccgaagatgaagccgactactactgcaactccctggagcggattggatacctgagctacgtgtttggtggcggcacgaagctcaccgtgctgggaagcggtggatcaaacccaatttgcaagggatgcctgagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgcttcagcaaggacttctgcactaagtgcaaagtcggcttctaccttcaccggggcagatgttttgacgaatgcccggatggcttcgccccgctggaggagactatggaatgcgtggagggcggagactacaaggacgacgatgacaagggctcccaccatcaccaccatcatcaccactag

SEQ ID NO: 12 - protein, 374 aa, Artificial Sequence
  Made in Lab: anti-ASGR1 and RSPO2 wild type fusion sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDFSSRRWYLEYWGQGTLVTVSSGGGGSGGGGSGGGGSELTQDPAVSVALGQTVRITCQGDSLRSYYASWYQQKPGQAPVLVIYGKNNRPSGIPDRFSGSSSGNTASLTITGAQAEDEADYYCNSLERIGYLSYVFGGGTKLTVLGSGGSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGGDYKDDDDKGSHHHHHHHH

SEQ ID NO: 13 - DNA, 1125 bp, Artificial Sequence
  Made in Lab: anti-ASGR1 and RSPO2 mutant fusion sequence
gaagtgcagctgctggaatccgggggcggactggtgcaacccgggggatccctcagactgtcctgtgccgcatcgggtttcactttctcctcctacgcgatgtcatgggtcagacaggcccctggaaaaggcctcgaatgggtgtcggctatctccggatcggggggatctacttactacgccgactccgtgaagggccggttcactatctcgagggacaactccaagaataccctgtacttgcaaatgaactccctgcgcgccgaggataccgcggtgtattactgcgccaaggacttcagctcacgccggtggtaccttgagtactggggacagggaacccttgtcaccgtgtccagcggtggcggcggaagcggcgggggcggatccggtggcgggggctcagagctcacccaggaccccgctgtgtccgtggccttgggacagaccgtgcgcatcacatgccagggcgatagcctgcggagctattacgcctcgtggtaccagcagaagcctggtcaagcgccggtcctggtcatctacggaaagaacaaccgcccgtccggaattccagacaggttcagcggatccagctcggggaacaccgcctcactgactatcaccggagcacaggccgaagatgaagccgactactactgcaactccctggagcggattggatacctgagctacgtgtttggtggcggcacgaagctcaccgtgctgggaagcggtggatcaaacccaatttgcaagggatgcctgagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggcggagactacaaggacgacgatgacaagggctcccaccatcaccaccatcatcaccactag

SEQ ID NO: 14 - protein, 374 aa, Artificial Sequence
  Made in Lab: anti-ASGR1 and RSPO2 mutant fusion sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDFSSRRWYLEYWGQGTLVTVSSGGGGSGGGGSGGGGSELTQDPAVSVALGQTVRITCQGDSLRSYYASWYQQKPGQAPVLVIYGKNNRPSGIPDRFSGSSSGNTASLTITGAQAEDEADYYCNSLERIGYLSYVFGGGTKLTVLGSGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGDYKDDDDKGSHHHHHHHH

SEQ ID NO: 15 - DNA, 1125 bp, Artificial Sequence
  Made in Lab: anti-ASGR1 and RSPO2 mutant fusion sequence
gaagtgcagctgctggaatccgggggcggactggtgcaacccgggggatccctcagactgtcctgtgccgcatcgggtttcactttctcctcctacgcgatgtcatgggtcagacaggcccctggaaaaggcctcgaatgggtgtcggctatctccggatcggggggatctacttactacgccgactccgtgaagggccggttcactatctcgagggacaactccaagaataccctgtacttgcaaatgaactccctgcgcgccgaggataccgcggtgtattactgcgccaaggacttcagctcacgccggtggtaccttgagtactggggacagggaacccttgtcaccgtgtccagcggtggcggcggaagcggcgggggcggatccggtggcgggggctcagagctcacccaggaccccgctgtgtccgtggccttgggacagaccgtgcgcatcacatgccagggcgatagcctgcggagctattacgcctcgtggtaccagcagaagcctggtcaagcgccggtcctggtcatctacggaaagaacaaccgcccgtccggaattccagacaggttcagcggatccagctcggggaacaccgcctcactgactatcaccggagcacaggccgaagatgaagccgactactactgcaactccctggagcggattggatacctgagctacgtgtttggtggcggcacgaagctcaccgtgctgggaagcggtggatcaaacccaatttgcaagggatgcctgagctgtagcaaggacaacggatgttcacggtgccagcaaaagctgtttttcttcctccgggccgaaggaatggccgcatacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggcggagactacaaggacgacgatgacaagggctcccaccatcaccaccatcatcaccactag

SEQ ID NO: 16 - protein, 374 aa, Artificial Sequence
  Made in Lab: anti-ASGR1 and RSPO2 mutant fusion sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDFSSRRWYLEYWGQGTLVTVSSGGGGSGGGGSGGGGSELTQDPAVSVALGQTVRITCQGDSLRSYYASWYQQKPGQAPVLVIYGKNNRPSGIPDRFSGSSSGNTASLTITGAQAEDEADYYCNSLERIGYLSYVFGGGTKLTVLGSGGSNPICKGCLSCSKDNGCSRCQQKLFFFLRAEGMAAYGECLHSCPSGYYGHRAPDMNRCARCRIENCDSCRSKDACTKCKVGFYLHRGRCFDECPDGFAPLEETMECVEGGDYKDDDDKGSHHHHHHHH

SEQ ID NO: 17 - DNA, 1134 bp, Artificial Sequence
  Made in Lab: anti-TFR1 and RSPO2 wild type fusion sequence
caagtgcaactccaacaaagcggtcccgagttggtccgacccggcgtcagtgtgaaaatctcatgcaaggggtccgggtataccttcactgactatgcaatgcactgggtaaagcagagccacgccaagtccttggagtggatcggaggcattagtacctacttcggacgcaccaactacaatcaaaaatttaagggtcgcgcaaccatgactgtagataaatcatcaagtaccgcgtacatggaattggctagactgacttctgaagattccgcgctgtattactgtgctcgcggtttgtctggcaactatgttatggattactgggggcaagggaccagcgtcacggtgtcctctggcggaggcgggtccggggggggtggttctggcggaggcggatccgatatagttctgtttcaatcccctgcgagcctggcggtaagtttgggacagagagccacgatttcctgccgagcgagtgaaagcgtagacgactacggcaattctttcatgcactggtatcaacagaagccaggccaaccgccgaagctgcttatctatcgcgcgtccaatttggagtcagggatccctgcacgattttcaggttctggaagtaggacagactttacacttacgataaaccccgtggaagcggatgacgtcgcaacctactattgtcaacaaagcaatgaagcaccacctaccttcggaggtggcactaaattggaaattaggggaagcggtggatcaaacccaatttgcaagggatgcctgagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgcttcagcaaggacttctgcactaagtgcaaagtcggcttctaccttcaccggggcagatgttttgacgaatgcccggatggcttcgccccgctggaggagactatggaatgcgtggagggcggagactacaaggacgacgatgacaagggctcccaccatcaccaccatcatcaccactag

SEQ ID NO: 18 - protein, 377 aa, Artificial Sequence
  Made in Lab: anti-TFR1 and RSPO2 wild type fusion sequence
QVQLQQSGPELVRPGVSVKISCKGSGYTFTDYAMHWVKQSHAKSLEWIGGISTYFGRTNYNQKFKGRATMTVDKSSSTAYMELARLTSEDSALYYCARGLSGNYVMDYWGQGTSVTVSSGGGGSGGGGSGGGGSDIVLFQSPASLAVSLGQRATISCRASESVDDYGNSFMHWYQQKPGQPPKLLIYRASNLESGIPARFSGSGSRTDFTLTINPVEADDVATYYCQQSNEAPPTFGGGTKLEIRGSGGSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVEGGDYKDDDDKGSHHHHHHHH

SEQ ID NO: 19 - DNA, 1134 bp, Artificial Sequence
  Made in Lab: anti-TFR1 and RSPO2 mutant fusion sequence
caagtgcaactccaacaaagcggtcccgagttggtccgacccggcgtcagtgtgaaaatctcatgcaaggggtccgggtataccttcactgactatgcaatgcactgggtaaagcagagccacgccaagtccttggagtggatcggaggcattagtacctacttcggacgcaccaactacaatcaaaaatttaagggtcgcgcaaccatgactgtagataaatcatcaagtaccgcgtacatggaattggctagactgacttctgaagattccgcgctgtattactgtgctcgcggtttgtctggcaactatgttatggattactgggggcaagggaccagcgtcacggtgtcctctggcggaggcgggtccggggggggtggttctggcggaggcggatccgatatagttctgtttcaatcccctgcgagcctggcggtaagtttgggacagagagccacgatttcctgccgagcgagtgaaagcgtagacgactacggcaattctttcatgcactggtatcaacagaagccaggccaaccgccgaagctgcttatctatcgcgcgtccaatttggagtcagggatccctgcacgattttcaggttctggaagtaggacagactttacacttacgataaaccccgtggaagcggatgacgtcgcaacctactattgtcaacaaagcaatgaagcaccacctaccttcggaggtggcactaaattggaaattaggggaagcggtggatcaaacccaatttgcaagggatgcctgagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggcggagactacaaggacgacgatgacaagggctcccaccatcaccaccatcatcaccactag

SEQ ID NO: 20 - protein, 377 aa, Artificial Sequence
  Made in Lab: anti-TFR1 and RSPO2 mutant fusion sequence
QVQLQQSGPELVRPGVSVKISCKGSGYTFTDYAMHWVKQSHAKSLEWIGGISTYFGRTNYNQKFKGRATMTVDKSSSTAYMELARLTSEDSALYYCARGLSGNYVMDYWGQGTSVTVSSGGGGSGGGGSGGGGSDIVLFQSPASLAVSLGQRATISCRASESVDDYGNSFMHWYQQKPGQPPKLLIYRASNLESGIPARFSGSGSRTDFTLTINPVEADDVATYYCQQSNEAPPTFGGGTKLEIRGSGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGDYKDDDDKGSHHHHHHHH

SEQ ID NO: 21 - DNA, 1134 bp, Artificial Sequence
  Made in Lab: anti-TFR1 and RSPO2 mutant fusion sequence
caagtgcaactccaacaaagcggtcccgagttggtccgacccggcgtcagtgtgaaaatctcatgcaaggggtccgggtataccttcactgactatgcaatgcactgggtaaagcagagccacgccaagtccttggagtggatcggaggcattagtacctacttcggacgcaccaactacaatcaaaaatttaagggtcgcgcaaccatgactgtagataaatcatcaagtaccgcgtacatggaattggctagactgacttctgaagattccgcgctgtattactgtgctcgcggtttgtctggcaactatgttatggattactgggggcaagggaccagcgtcacggtgtcctctggcggaggcgggtccggggggggtggttctggcggaggcggatccgatatagttctgtttcaatcccctgcgagcctggcggtaagtttgggacagagagccacgatttcctgccgagcgagtgaaagcgtagacgactacggcaattctttcatgcactggtatcaacagaagccaggccaaccgccgaagctgcttatctatcgcgcgtccaatttggagtcagggatccctgcacgattttcaggttctggaagtaggacagactttacacttacgataaaccccgtggaagcggatgacgtcgcaacctactattgtcaacaaagcaatgaagcaccacctaccttcggaggtggcactaaattggaaattaggggaagcggtggatcaaacccaatttgcaagggatgcctgagctgtagcaaggacaacggatgttcacggtgccagcaaaagctgtttttcttcctccgggccgaaggaatggccgcatacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggcggagactacaaggacgacgatgacaagggctcccaccatcaccaccatcatcaccactag

SEQ ID NO: 22 - protein, 377 aa, Artificial Sequence
  Made in Lab: anti-TFR1 and RSPO2 mutant fusion sequence
QVQLQQSGPELVRPGVSVKISCKGSGYTFTDYAMHWVKQSHAKSLEWIGGISTYFGRTNYNQKFKGRATMTVDKSSSTAYMELARLTSEDSALYYCARGLSGNYVMDYWGQGTSVTVSSGGGGSGGGGSGGGGSDIVLFQSPASLAVSLGQRATISCRASESVDDYGNSFMHWYQQKPGQPPKLLIYRASNLESGIPARFSGSGSRTDFTLTINPVEADDVATYYCQQSNEAPPTFGGGTKLEIRGSGGSNPICKGCLSCSKDNGCSRCQQKLFFFLRAEGMAAYGECLHSCPSGYYGHRAPDMNRCARCRIENCDSCRSKDACTKCKVGFYLHRGRCFDECPDGFAPLEETMECVEGGDYKDDDDKGSHHHHHHHH

SEQ ID NO: 23 - DNA, 1053 bp, Artificial Sequence
  Made in Lab: Fc-RSPO2 fusion sequence
gacaaaactcacacatgcccaccgtgcccagcacctgaagccgcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggaggaggaggctccggtggcggtggcagctcaaatcccatttgcaagggttgtttgtcttgttcaaaggacaatgggtgtagccgatgtcaacagaagttgttcttcttccttcgaagagaagggatgcgccagtatggagagtgcctgcattcctgcccatccgggtactatggacaccgagccccagatatgaacagatgtgcaagatgcagaatagaaaactgtgattcttgctttagcaaagacttttgtaccaagtgcaaagtaggcttttatttgcatagaggccgttgctttgatgaatgtccagatggttttgcaccattagaagaaaccatggaatgtgtggaatga

SEQ ID NO: 24 - protein, 350 aa, Artificial Sequence
  Made in Lab: Fc-RSPO2 fusion sequence
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSSNPICKGCLSCSKDNGCSRCQQKLFFFLRREGMRQYGECLHSCPSGYYGHRAPDMNRCARCRIENCDSCFSKDFCTKCKVGFYLHRGRCFDECPDGFAPLEETMECVE

SEQ ID NO: 25 - DNA, 642 bp, Artificial Sequence
  Made in Lab: anti-GFP light chain sequence
gacatcgaactcacccagcccccgtcagtgtccgtggcccctggacagactgcgcgcatctcctgctccggcgacaacctggggaagaaatacgtgtactggtaccagcagaagccaggtcaagcccctgtgctggtcatctacggcgacgacgaaaggccgtcaggcatcccagagcgcttctccggctccaactccgggaatactgccacccttaccatttccggaacccaggccgaggatgaagcggattactattgcgcgagctacgatagcagccacatcctgatcgtgtttggaggcggtaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 26 - protein, 214 aa, Artificial Sequence
  Made in Lab: anti-GFP light chain sequence
DIELTQPPSVSVAPGQTARISCSGDNLGKKYVYWYQQKPGQAPVLVIYGDDERPSGIPERFSGSNSGNTATLTISGTQAEDEADYYCASYDSSHILIVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 27 - DNA, 1695 bp, Artificial Sequence
  Made in Lab: RSPO2 mutant and anti-GFP Heavy chain IgG2 fusion polynucleotide
aacccaatttgcaagggatgcctgagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggtggtggtggctcgggaggaggaggctccggtggcggtggcagccaggtccagttggtggaatccggagggggtttggtccagcctggtggaagcctgcgcctctcatgcgccgctagcggattcaccttctcccgatacggcatgcattgggtcagacaggcacccggaaaaggactcgaatgggtgtcgggcatttcctcgatcgggtcaaacacctattacgccgactccgtgaagggacggttcaccattagccgggataacagcaagaacactctgtacttgcaaatgaactccctgcgggctgaggacaccgccgtgtactactgtgcgcggtggtacaagacctatattgacgtctggggacagggtaccctcgtgaccgtgtcgagtgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 28 - protein, 565 aa, Artificial Sequence
  Made in Lab: RSPO2 mutant and anti-GFP Heavy chain IgG2 fusion polypeptide
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGGGGSGGGGSQVQLVESGGGLVQPGGSLRLSCAASGFTFSRYGMHWVRQAPGKGLEWVSGISSIGSNTYYADSVKGRFTISRDNSKNTLYLQMNSLRAEDTAVYYCARWYKTYIDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 29 - DNA, 645 bp, Artificial Sequence
  Made in Lab: anti-ASGR1 light chain polynucleotide
gacatcgagctcacccaggaccccgctgtgtccgtggccttgggacagaccgtgcgcatcacatgccagggcgatagcctgcggagctattacgcctcgtggtaccagcagaagcctggtcaagcgccggtcctggtcatctacggaaagaacaaccgcccgtccggaattccagacaggttcagcggatccagctcggggaacaccgcctcactgactatcaccggagcacaggccgaagatgaagccgactactactgcaactccctggagcggattggatacctgagctacgtgtttggtggcggtaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 30 - protein, 215 aa, Artificial Sequence
  Made in Lab: anti-ASGR1 light chain polypeptide
DIELTQDPAVSVALGQTVRITCQGDSLRSYYASWYQQKPGQAPVLVIYGKNNRPSGIPDRFSGSSSGNTASLTITGAQAEDEADYYCNSLERIGYLSYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 31 - DNA, 1344 bp, Artificial Sequence
  Made in Lab: RSPO2 mutant and anti-ASGR1 Heavy chain IgG2 fusion polynucleotide
caggtccagttggtggaatccggagggggtttggtccagcctggtggaagcctgcgcctctcatgcgccgctagcggattcaccttctcccgatacggcatgcattgggtcagacaggcacccggaaaaggactcgaatgggtgtcgggcatttcctcgatcgggtcaaacacctattacgccgactccgtgaagggacggttcaccattagccgggataacagcaagaacactctgtacttgcaaatgaactccctgcgggctgaggacaccgccgtgtactactgtgcgcggtggtacaagacctatattgacgtctggggacagggtaccctcgtgaccgtgtcgagtgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 32 - protein, 568 aa, Artificial Sequence
  Made in Lab: RSPO2 mutant and anti-ASGR1 Heavy chain IgG2 fusion polypeptide
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDFSSRRWYLEYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 33 - DNA, 1344 bp, Artificial Sequence; identical to SEQ ID NO: 31
  Made in Lab: SZC-09033-pFUSEss-aGFP-VH-CHIg-hG1 fusion polynucleotide

SEQ ID NO: 34 - protein, 447 aa, Artificial Sequence
  Made in Lab: SZC-09033-pFUSEss-aGFP-VH-CHIg-hG1 fusion polypeptide
QVQLVESGGGLVQPGGSLRLSCAASGFTFSRYGMHWVRQAPGKGLEWVSGISSIGSNTYYADSVKGRFTISRDNSKNTLYLQMNSLRAEDTAVYYCARWYKTYIDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - DNA, 693 bp, Homo sapiens
cagaacagccagctccaggaagaactgaggggcctccgcgaaaccttctccaacttcacggcttcgaccgaagctcaagtcaaggggttgtccacacaaggcggcaacgtcggacgcaagatgaagtcgctggagtcccagctggaaaagcagcagaaggatctctccgaggatcacagctcactgctgttgcacgtgaagcagttcgtgtcggacctgaggtccctgagctgtcagatggcggcactgcagggaaacggttccgaaagaacttgctgccctgtgaattgggtggagcacgagagaagctgctactggttctcgcggtccggcaaagcctgggcggacgccgacaactattgtcggctggaggatgcgcacctggtggtcgtgacctcctgggaggaacagaagtttgtgcagcaccatatcggtcccgtgaacacttggatggggctgcacgaccaaaacggaccgtggaaatgggtggatgggactgattacgaaaccggattcaagaactggcgcccagagcagcccgacgattggtacggacatggactggggggcggagaggactgcgcccacttcaccgacgacggccggtggaacgacgacgtgtgccagcggccgtaccgctgggtctgcgaaaccgagctggacaaggccagccaggagccacctctcctttga

SEQ ID NO: 36 - protein, 230 aa, Homo sapiens
QNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 37 - DNA, 684 bp, Homo sapiens
aggggcgcacagctgcaagccgagctgcggtccctgaaggaagctttctcaaacttctcgagctcgaccctcaccgaagtgcaggccattagcacccacgggggttccgtgggggacaagatcacctcgctgggagcgaagctggagaagcagcagcaagacctcaaggccgaccacgacgcgctgctgttccacttgaagcacttcccagtggacttgcggttcgtggcgtgccagatggagctgctgcactccaatgggagccagagaacttgttgccctgtgaactgggtggaacaccagggatcctgctactggtttagccactccggaaaggcctgggccgaagccgagaagtactgccagcttgagaacgcgcacctggtcgtgatcaactcctgggaagaacagaagttcattgtgcaacacactaacccgttcaacacctggatcggcctgaccgactccgacggctcatggaaatgggtggacggaaccgattaccggcataactataagaactgggccgtgactcagccggataattggcacggacacgagctgggtggatccgaggactgcgtcgaagtgcagcccgacggcagatggaacgatgacttctgtctgcaagtgtaccgctgggtctgcgagaagcgccgcaacgccactggcgaagtggcttga

SEQ ID NO: 38 - protein, 227 aa, Homo sapiens
RGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 39 - DNA, 690 bp, Homo sapiens
caaaacgcccagctgcagcgggagctgcggggcctgagagagacgctcagcaacttcacagcgagcaccgaggcccaggtcaagggcttgagcacccagggaggcaatgtgggaagaaagatgaagtcgctggagtcccagctggagaaacagcagaaggacttgagtgaagatcactccagcctgctgctccacgtgaagcagttcgtgtctgacctgcggagcctgagctgtcagatggcggcgctccagggcaatggctcggaaagggcctgctgcccagtcaactgggtggagcacgagcgcagctgctactggttctctcgctccgggaaggcctgggccgacgccgacaactactgccggctggaggacgcgcacctggtggtggtcacgtcctgggaggagcagaaatttgtccagcaccacataggtcctgtgaacacctggatgggcctccacgaccaaaacgggccctggaagtgggtggacgggacggactacgagacgggcttcaagaactggagaccggagcagccggacgactggtacggccacgggctcgggggaggggaggactgtgcccacttcaccgacgacggccgctggaacgacgacgtctgccagaggccctaccgctgggtctgcgagacagagctggacaaggccagtcaggagccacctctcctt

SEQ ID NO: 40 - protein, 230 aa, Homo sapiens
QNAQLQRELRGLRETLSNFTASTEAQVKGLSTQGGNVGRKMKSLESQLEKQQKDLSEDHSSLLLHVKQFVSDLRSLSCQMAALQGNGSERACCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 41 - DNA, 684 bp, Homo sapiens
caaagtgcacagctgcaagcagagatgcggagcctgaaggaagctttcagcaacttctcctcgagcacgctggtggaggtccatgctctcggcacccacggaggcagcgtgggtgacaagatcacatccctaggagacaagttggagaaacagcagcacgacctgaaagcagatcatgacatcctgctcctccatctgaagcacttccccgtggacctgcgcttcgtggcctgccagatggagctcctccacagcaacggctcccaaaggacctgctgccctgtcaactgggtggagcaccaaggcagctgctactggttctctcgctccgggaaggcctgggccgaggcggagaagtactgccagctggagaactcacacctggtggtcatcaactcctgggaggagcagaaattcattgtacaacacacgaaccccttcaatacctggataggtctcacggacagtgatggctcctggaaatgggtggacggcacagactataggcacaactacaagaactgggctgtcactcagccagatgattggcacgggcatgagctgggcggaagtgaagactgtgttgaagtccggccggatggccgctggaacgatgatttctgcctgcaggtgcaccgctgggtgtgtgagaagaggcggaatgccaccggcgaggcagcctga

SEQ ID NO: 42 - protein, 227 aa, Homo sapiens
QSAQLQAEMRSLKEAFSNFSSSTLVEVHALGTHGGSVGDKITSLGDKLEKQQHDLKADHDILLLHLKHFPVDLRFVACQMELLHSNGSQRTCCPVNWVEHQGSCYWFSRSGKAWAEAEKYCQLENSHLVVINSWEEQKFIVQHTNPFNTWIGLTDSDGSWKWVDGTDYRHNYKNWAVTQPDDWHGHELGGSEDCVEVRPDGRWNDDFCLQVHRWVCEKRRNATGEAA

SEQ ID NO: 43 - DNA, 468 bp, Homo sapiens
cagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgattga

SEQ ID NO: 44 - protein, 155 aa, Homo sapiens
QKAIIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYD

SEQ ID NO: 45 - DNA, 495 bp, Homo sapiens
aaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatgtga

SEQ ID NO: 46 - protein, 164 aa, Homo sapiens
KETAFVEVVLFESSPSGDYTTYTTGLTGRFSRAGATLSAEGEIVQMHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDM

SEQ ID NO: 47 - protein, 103 aa, Artificial Sequence
  Made in lab - synthesized chain
EIVLTQSPATLSFSPGERATLSCRASQSVGSYLAWYQQRPGQAPRPLIYDATNRATGIPTRFSGSGSGTDFTLTISSLEPEDFATYYCQHRRTFGRGTKLEIK

SEQ ID NO: 48 - protein, 122 aa, Artificial Sequence
  Made in lab - synthesized chain
QVQLQQSGPGLVKPSQTLSLTCAISGDSVSSNSAAWNWMRQSPSRGLEWLGRTYYRSKWYNDYAVSVKSRMTINPDTSRNQFSLQLNSVTLEDTAVYYCARWNHEEHYFDYWGQGTLVTVSS

SEQ ID NO: 49 - protein, 103 aa, Artificial Sequence
  Made in lab - synthesized chain
DVVMTQSPATLSFSPGERATLSCRASQSVGSYLAWYQQRPGQAPRPLIYDATNRATGIPTRFSGSGSGTDFTLTISSLEPEDFATYYCQHRRTFGRGTKLEIK

SEQ ID NO: 50 - protein, 122 aa, Artificial Sequence
  Made in lab - synthesized chain
QVQLQQSGPGLVKPSQTLSLTCAISGASVSSNSAAWNWIRQSPSRGLEWLGRTYYRSKWYNDYAVSVKSRITINPDTSKNQFSLQLNSVTPGDTAVYYCARWNHEEHYFDYWGQGTLVTVSS

SEQ ID NO: 51 - protein, 103 aa, Artificial Sequence
  Made in lab - synthesized chain
DIQLTQSPATLSFSPGERATLSCRASQSVGSYLAWYQQRPGQAPRPLIYDATNRATGIPTRFSGSGSGTDFTLTISSLEPEDFATYYCQHRRTFGRGTKLEIK

SEQ ID NO: 52 - protein, 120 aa, Artificial Sequence
  Made in lab - synthesized chain
QVQLQQSGPGLVKPSQTLSLTCAISGDSVSSNSVAWNWMRQSPSRGLEWLGRTYYRSKWYYDYAVSVKSRITINPDTSKNQFSLQLNSVTPEDTAVYYCASWTRGAFDIWGQGTMVTVSS

SEQ ID NO: 53 - protein, 107 aa, Artificial Sequence
  Made in lab - synthesized chain
EIVMTQSPATLSLSPGERATLSCRASQSVGSYLAWYQQKPGLAPRLLIYDASNRATGIPARFSGSGSGTDFTLTISSLEPEDFAVYYCQQRSNWPLTFGGGTKVEIK

SEQ ID NO: 54 - protein, 117 aa, Artificial Sequence
  Made in lab - synthesized chain
EVQLVESGAEVKKPGSSVKVSCKASGGTFSSYAISWVRQAPGQGLEWMGGIIPIFGTANYAQKFQGRVTITADESTSTAYMELSSLRSEDTAVYYCAVSDGYDLDYWGQGTLVTVSS

SEQ ID NO: 55 - protein, 107 aa, Artificial Sequence
  Made in lab - synthesized chain
EIVLTQSPATLSLSPGERATLSCRASQSVSSYLAWYQQKPGQAPRLLIHDASNRATGIPARFSGSGSGTDFTLIISSLEPEDFAVYYCQQRSNWPVTFGGGTKVEIK

SEQ ID NO: 56 - protein, 117 aa, Artificial Sequence
  Made in lab - synthesized chain
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCASFGVGAPDYWGQGTLVTVSS

SEQ ID NO: 57 - protein, 112 aa, Artificial Sequence
  Made in lab - synthesized chain
DVVMTQSPLSLPVTPGEPASISCRSSQSLLHSDGHNYLQWYLQKPGQSPQLLILLGSYRASGVPDRFSGSGSGTDFTLKISRVEAEDVGVYYCMQATHWPPTFGQGTKVEIK

SEQ ID NO: 58 - protein, 114 aa, Artificial Sequence
  Made in lab - synthesized chain
EVQLVQSGAEVKKPGATVKVSCKASGYTFTSYGISWVRQAPGQGLEWMGWISAYNGNTNYAQKLQGRVTMTTDTSTSTAYMELRSLRSDDTAVYYCASAGGGYWGQGTLVTVSS

SEQ ID NO: 59 - protein, 107 aa, Artificial Sequence
  Made in lab - synthesized chain
DIQMTQSPSSLSASVGDRVTITCRASQNIYTYLNWYQQKPGKAPKLLIYAASSLQSGVPSRFSGSGSGTDFTLTISSLQPEDFATYYCQQYYNYPITFGQGTRLEIK

SEQ ID NO: 60 - protein, 117 aa, Artificial Sequence
  Made in lab - synthesized chain
QVQLVQSGAEVKKPGSSVKVSCKASGYTFTGYHMHWVRQAPGQGLEWVGGIIPVFGAPNYAQKFQGRVTITADESTSTAYMELSSLRSEDTAVYYCARDGGYGMDVWGQGTMVTVSS

SEQ ID NO: 61 - protein, 107 aa, Artificial Sequence
  Made in lab - synthesized chain
DIQMTQSPSSLSASVGDRVTITCRASQGISSWLAWYQQKPGKAPKLLIYAASSLQSGVPSRFSGSGSGTDFTLTISSLQPEDFATYYCQQAYDFPLTFGGGTKVEIK

SEQ ID NO: 62 - protein, 120 aa, Artificial Sequence
  Made in lab - synthesized chain
QVQLVQSGAEVKKPGASVKVSCKASGYTFTGYYMHWVRQAPGQGLEWMGIINPSGGGTSYAQKFQGRVTMTRDTSTSTVYMELSSLRSEDTAVYYCARDTGATAEYFQHWGQGTLVTVSS

SEQ ID NO: 63 - protein, 107 aa, Artificial Sequence
  Made in lab - synthesized chain
DIQMTQSPSSLSASVGDRVTITCRASQSISSWLAWYQQKPGKAPKLLIYAATTLQSGVPSRFSGSGSGTDFTLTISSLQPEDFATYYCQQSYSTPLTFGQGTKLEIK

SEQ ID NO: 64 - protein, 119 aa, Artificial Sequence
  Made in lab - synthesized chain
QVQLVQSGAEVKKPGSSVKVSCKASGYSFTGNYMHWVRQAPGQGLEWMGGIIPMFGTVKYAQKFQGRVTITADESTSTAYMELSSLRSEDTAVYYCAKDRGYRFDFDLWGRGTLVTVSS

SEQ ID NO: 65 - protein, 107 aa, Artificial Sequence
  Made in lab - synthesized chain
DIQMTQSPSSLSASVGDRVTITCRASQGIATWLAWYQQKPGKAPKLLIYDASNLQSGVPSRFSGSGSGTDFTLTISSLQPEDFATYYCQQANSFPVTFGPGTKVDIK

SEQ ID NO: 66 - protein, 123 aa, Artificial Sequence
  Made in lab - synthesized chain
EVQLLESGGGLVQPGGSLRLSCAASGFTFSSYAMSWVRQAPGKGLEWVSYISSYNSHTNDADSVKGRFTISRDNSKNTLYLQMNSLRAEDTAVYYCARWAVAAGGQYYYMDVWGKGTTVTVSS

SEQ ID NO: 67 - protein, 107 aa, Artificial Sequence
  Made in lab - synthesized chain
DIQMTQSPSSLSASVGDRVTITCRASQSISRYLNWYQQKPGKAPKLLIYDASNLRSGVPSRFSGSGSGTDFTLTISSLQPEDFATYYCQQGYTIPITFGQGTKVEIK

SEQ ID NO: 68 - protein, 122 aa, Artificial Sequence
  Made in lab - synthesized chain
QVQLVQSGAEVKKTGASVKVSCKASGYTFSNYYMHWVRQAPGQGLEWMGWINPKSGGTKYAQKFQGRVTMTRDTSTSTVYMELSSLRSEDTAVYYCARDRGITMVRGVMDYWGQGTLVTVSS

SEQ ID NO: 69 - protein, 107 aa, Artificial Sequence
  Made in lab - synthesized chain
DIQMTQSPSSLSASVGDRVTITCRASQSISSYLNWYQQKPGKAPKLLIYQASNKDTGVPSRFSGSGSGTDFTLTISSLQPEDFATYYCQQGYSTPLTFGGGTKVEIK

SEQ ID NO: 70 - protein, 122 aa, Artificial Sequence
  Made in lab - synthesized chain
QVQLVQSGAEVKKPGATVKVSCKASGYTFTTYYMHWVRQAPGQGLEWMGWINPNGGGTNYAQKFQGRVTMTRDTSTSTVYMELSSLRSEDTAVYYCAKDRTAMAPEGAFDIWGQGTMVTVSS

SEQ ID NO: 71 - protein, 107 aa, Artificial Sequence
  Made in lab - synthesized chain
DIQMTQSPSSLSASVGDRVTITCRASQSINNYLNWYQQKPGKAPKLLIYAASSLQSGVPSRFSGSGSGTDFTLTISSLQPEDFATYYCQQANSFPLTFGGGTKVEIK

SEQ ID NO: 72 - protein, 117 aa, Artificial Sequence
  Made in lab - synthesized chain
QVQLVQSGAEVKKPGASVKVSCKASGYTFSDYYVHWVRQAPGQGLEWMGIINPRNGRTSYAQRFQGRVTMTRDTSTSTVYMELSSLRSEDTAVYYCARDHLYGMDVWGQGTTVTVSS

SEQ ID NO: 73 - protein, 112 aa, Artificial Sequence
  Made in lab - synthesized chain
DIVMTQSPLSLPVTPGEPASISCRSSQSLLHSNGYNYLDWYLQKPGQSPQLLIYAASNLQSGVPDRFSGSGSGTDFTLKISRVEAEDVGVYYCMQALQTPLTFGGGTKVEIK

SEQ ID NO: 74 - protein, 127 aa, Artificial Sequence
  Made in lab - synthesized chain
EVQLLESGGGLVQPGGSLRLSCAASGFTVSSNYMSWVRQAPGKGLEWVSAISGSGGSTYYADSVKGRFTISRDNSKNTLYLQMNSLRAEDTAVYYCAKDSPIVRRGERGRYYGMDVWGQGTTVTVSS

SEQ ID NO: 75 - protein, 107 aa, Artificial Sequence
  Made in lab - synthesized chain
DIQMTQSPSSLSASVGDRVTITCRASQSISNWLAWYQQKPGKAPKLLIYAASRLQSGVPSRFSGSGSGTDFTLTISSLQPEDFATYYCQQTYAIPLTFGGGTKVEIK

SEQ ID NO: 76 - protein, 118 aa, Artificial Sequence
  Made in lab - synthesized chain
QVQLVQSGAEVKKPGASVKVSCKASGYTFTDYNMHWVRQAPGQGLEWMGWMNPNTGNTAYAQKFQGRVTMTRDTSTSTVYMELSSLRSEDTAVYYCARDKNYYGMDVWGQGTTVTVSS

SEQ ID NO: 77 - protein, 119 aa, Artificial Sequence
  Made in lab - synthesized chain
EVQLVESGGGLVQAGDSLRLSCTASGHTFSSYAMGWFRQAPGKEREFVAAISQSGYVRYYADSVKGRFTISRDNAKNTVYLQMNSLKPDDTAVYYCNARWGAGSLFASWGQGTQVTVSS

SEQ ID NO: 78 - protein, 107 aa, Artificial Sequence
  Made in lab - synthesized chain
DIQMTQSPSSLSASVGDRVTITCRSSQSIRTYLNWYQQKPGKAPKLLIYAASTLQSGVPSRFSGSGSGTDFTLTISSLQPEDFATYYCQQANSFPITFGGGTKVEIK

SEQ ID NO: 79 - protein, 117 aa, Artificial Sequence
  Made in lab - synthesized chain
QVQLVQSGAEVKKPGASVKVSCKASGYTFTGYYMHWVRQAPGQGLEWMGIINPSGGSTSYAQKFQGRVTMTRDTSTSTVYMELSSLRSEDTAVYYCARGRQGVWDYWGRGTLVTVSS

SEQ ID NO: 80 - protein, 107 aa, Artificial Sequence
  Made in lab - synthesized chain
DIQMTQSPSSLSASVGDRVTITCRVSQGISSYLNWYQQKPGKAPKLLIYAASTLQSGVPSRFSGSGSGTDFTLTISSLQPEDFATYYCQQSYGAPLTFGQGTKVEIK

SEQ ID NO: 81 - protein, 128 aa, Artificial Sequence
  Made in lab - synthesized chain
QVQLVQSGAEVKKPGASVKVSCKASGYTFTSYYLHWVRQAPGQGLEWMGWMNPNSGNTGYAQNFQGRVTMTRDTSTSTVYMELSSLRSEDTAVYYCARGDFWSGYYPYYYYYYGMDVWGQGTTVTVSS

SEQ ID NO: 82 - protein, 112 aa, Artificial Sequence
  Made in lab - synthesized chain
DIVMTQSPLSLPVTPGEPASISCRSSQSLLHSNGYNYLDWYLQKPGQSPQLLIYDASNLETGVPDRFSGSGSGTDFTLKISRVEAEDVGVYYCMQTLHTPYTFGQGTKLEIK

SEQ ID NO: 83 - protein, 119 aa, Artificial Sequence
  Made in lab - synthesized chain
QVQLVQSGAEVKKPGASVKVSCKASGYTFTAYYMHWVRQAPGQGLEWMGIINPNGGRTTYAQKFQGRVTMTRDTSTSTVYMELSSLRSEDTAVYYCARSFGVAGTLDYWGQGTLVTVSS

SEQ ID NO: 84 - protein, 113 aa, Artificial Sequence
  Made in lab - synthesized chain
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSDPITFGQGTRLEIK

SEQ ID NO: 85 - protein, 118 aa, Artificial Sequence
  Made in lab - synthesized chain
QVQLVQSGAEVKKPGSSVKVSCKASGYTFTSYDINWVRQAPGQGLEWMGVINPGGSDTTYAQKFQGRVTITADESTSTAYMELSSLRSEDTAVYYCARDGYYYGMDVWGQGTTVTVSS

SEQ ID NO: 86 - protein, 107 aa, Artificial Sequence
  Made in lab - synthesized chain
DIQMTQSPSSLSASVGDRVTITCRASENIHKYLNWYQQKPGKAPKLLIYAASSLQSGVPSRFSGSGSGTDFTLTISSLQPEDFATYYCQQGYSTPYTFGQGTKLEIK

SEQ ID NO: 87 - protein, 121 aa, Artificial Sequence
  Made in lab - synthesized chain
QVQLVQSGAEVKKPGASVKVSCKASGYTFTNYYMHWVRQAPGQGLEWMGWINPHSGGTNYAQKFQGRVTMTRDTSTSTVYMELSSLRSEDTAVYYCAREDYNWNDGWFDPWGQGTLVTVSS

SEQ ID NO: 88 - protein, 107 aa, Artificial Sequence
  Made in lab - synthesized chain
DIQMTQSPSSLSASVGDRVTITCRASQNIYDWLAWYQQKPGKAPKLLIYDASNLETGVPSRFSGSGSGTDFTLTISSLQPEDFATYYCQQTYSTPFTFGPGTKVDIK

SEQ ID NO: 89 - protein, 127 aa, Artificial Sequence
  Made in lab - synthesized chain
QVQLVQSGAEVKKPGASVKVSCKASGGTFSNYAISWVRQAPGQGLEWMGWINPNSGGTNYAQKFQGRVTMTRDTSTSTVYMELSSLRSEDTAVYYCAKDSGYCSSTSCYDGGYFDLWGRGTLVTVSS

SEQ ID NO: 90 - protein, 112 aa, Artificial Sequence
  Made in lab - synthesized chain
DIVMTQSPLSLPVTPGEPASISCRSSQSLLHSNGYNYLDWYLQKPGQSPQLLIYLGSYRASGVPDRFSGSGSGTDFTLKISRVEAEDVGVYYCMQALQTPLTFGGGTKVEIK

SEQ ID NO: 91 - protein, 120 aa, Artificial Sequence
  Made in lab - synthesized chain
EVQLVESGGGLVKPGGSLRLSCAASGFTFSSYAMHWVRQAPGKGLEWVSAISGSGTYYADSVKGRFTISRDDSKNTLYLQMNSLKTEDTAVYYCARDQGHDYGDYEIDYWGQGTLVTVSS

SEQ ID NO: 92 - protein, 107 aa, Artificial Sequence
  Made in lab - synthesized chain
DIQMTQSPSSLSASVGDRVTITCRASQSIRSYLNWYQQKPGKAPKLLIYAASSLQSGVPSRFSGSGSGTDFTLTISSLQPEDFATYYCLQDYDYPLTFGGGTKVEIK

SEQ ID NO: 93 - protein, 120 aa, Artificial Sequence
  Made in lab - synthesized chain
QVQLVQSGAEVKKPGASVKVSCKASGYTFTNYYMHWVRQAPGQGLEWMGIINPSGGSANYAQKFQGRVTMTRDTSTSTVYMELSSLRSEDTAVYYCARDPVRGISAFDYWGQGTLVTVSS

SEQ ID NO: 94 - protein, 128 aa, Artificial Sequence
  Made in lab - synthesized chain
DVQLVESGGGLVQPGGSLRLSCAASGFTFSSYAMSWVRQAPGKGLEWVSVINSGGGSTSYAESVKGRFIISRDNAKNTLYLQMNSLKPEDTAVYYCARGTYYSGSYYYPALYYGMDYWGKGTQVTVSS

SEQ ID NO: 95 - protein, 108 aa, Artificial Sequence
  Made in lab - synthesized chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIK

SEQ ID NO: 96 - protein, 121 aa, Artificial Sequence
  Made in lab - synthesized chain
EVQLVQSGAEVKKPGASVKVSCKASGYTFTSYAMHWVRQAPGQRLEWMGWINAGNGNTKYSQTFQGRVTITRDTSASTAYMELSSLRSEDTAVYYCARDLMVRGGPPFDYWGQGTLVTVSS

SEQ ID NO: 97 - protein, 108 aa, Artificial Sequence
  Made in lab - synthesized chain
ETTLTQSPGTLSLSPGERATLSCRASQSVNSRYLAWYQQKPGQAPRLLIYGASSRATGIPDRLTGSGSGTDFTLTISRLEPEDFAVYYCQQYGSSRLTFGGGTKVEIK

SEQ ID NO: 98 - protein, 122 aa, Artificial Sequence
  Made in lab - synthesized chain
QVQLQQSGPGLVKPSQTLSLTCAISGDSVSSNSAAWYWIRQSPSRGLEWLGRTYYRSKWYHDYAVSVKSRITINADTSKNQFSLQLNSVTPEDTAVYYCARVVRAVDAFDIWGQGTMVTVSS

SEQ ID NO: 99 - protein, 108 aa, Artificial Sequence
  Made in lab - synthesized chain
EIVMTQSPATLSVSPGERATLSCRASQSVSSSNLAWYQQKPGQAPRLLIYATSTRATGIPARFSGSGSGTEFTLTISSLQSEDFAVYYCQQYGSSPITFGGGTKVEIK

SEQ ID NO: 100 - protein, 124 aa, Artificial Sequence
  Made in lab - synthesized chain
QVQLVQSGAEVKKPGASVKVSCKASGYTFTSYYMHWVRQAPGQGLEWMGWMNPNSGNTGYAQKFQGRVTMTRDTSTSTVYMELSSLRSEDTAVYYCARGRVVRGVIISYGMDVWGQGTTVTVSS

SEQ ID NO: 101 - protein, 107 aa, Artificial Sequence
  Made in lab - synthesized chain
DIQMTQSPSSLSASVGDRVTITCRASQNIRSWLAWYQQKPGKAPKLLIYDASSLQRGVPSRFSGSGSGTDFTLTISSLQPEDFATYYCQQSYSTPPTFGQGTKLEIK

SEQ ID NO: 102 - protein, 122 aa, Artificial Sequence
  Made in lab - synthesized chain
QVQLVQSGAEVKKPGSSVKVSCKASGDTFTGYYIHWVRQAPGQGLEWMGGIIPIFDAATYAQKFQGRVTITADESTSTAYMELSSLRSEDTAVYYCTRARGQRSGYSYFDLWGRGTLVTVSS

SEQ ID NO: 103 - protein, 107 aa, Artificial Sequence
  Made in lab - synthesized chain
DIQMTQSPSSLSASVGDRVTITCRAGQSISRFLNWYQQKPGKAPKLLIYAASSLQSGVPSRFSGSGSGTDFTLTISSLQPEDFATYYCQQSYSTPYTFGQGTKLEIK

SEQ ID NO: 104 - protein, 119 aa, Artificial Sequence
  Made in lab - synthesized chain
QVQLVQSGAEVKKPGASVKVSCKASGGTFSTSGITWVRQAPGQGLEWMGWMNPNTGGIKYSQKFQGRVTMTRDTSTSTVYMELSSLRSEDTAVYYCAKSRALKGSYTSWGQGTLVTVSS

SEQ ID NO: 105 - protein, 107 aa, Artificial Sequence
  Made in lab - synthesized chain
DIQMTQSPSSLSASVGDRVTITCRASQSISRWLAWYQQKPGKAPKLLIYDASSLETGVPSRFSGSGSGTDFTLTISSLQPEDFATYYCQQAYSFPWTFGQGTKVEIK

SEQ ID NO: 106 - protein, 120 aa, Artificial Sequence
  Made in lab - synthesized chain
QVQLVQSGAEVKKPGSSVKVSCKASGGTFSNTDINWVRQAPGQGLEWMGGIIPIFGTANYAQKFQGRVTITADESTSTAYMELSSLRSEDTAVYYCVGGRSGWIWYFDLWGRGTLVTVSS

SEQ ID NO: 107 - protein, 107 aa, Artificial Sequence
  Made in lab - synthesized chain
DIQMTQSPSSLSASVGDRVTITCQASQDISRYLNWYQQKPGKAPKLLIYAASSLQSGVPSRFSGSGSGTDFTLTISSLQPEDFATYYCQQSYSRPFTFGPGTKVDIK

SEQ ID NO: 108 - protein, 119 aa, Artificial Sequence
  Made in lab - synthesized chain
QVQLVQSGAEVKKPGASVKVSCKASGGTFSNYSLSWVRQAPGQGLEWMGIINPRRGSTRYAQNFQGRVTMTRDTSTSTVYMELSSLRSEDTAVYYCARDGLGVDAFDIWGQGTMVTVSS

SEQ ID NO: 109 - protein, 107 aa, Artificial Sequence
  Made in lab - synthesized chain
DIQMTQSPSSLSASVGDRVTITCRASQDISNSLNWYQQKPGKAPKLLIYAASTLQSGVPSRFSGSGSGTDFTLTISSLQPEDFATYYCQQSYSPPHTFGGGTKVEIK

SEQ ID NO: 110 - protein, 118 aa, Artificial Sequence
  Made in lab - synthesized chain
EVQLLESGGGLVQPGGSLRLSCAASGFTFSNYAMGWVRQAPGKGLEWVSYISRSSSTIYYADSVKGRFTISRDNSKNTLYLQMNSLRAEDTAVYYCARRRDGYNWGYWGQGTLVTVSS

SEQ ID NO: 111 - protein, 107 aa, Artificial Sequence
  Made in lab - synthesized chain
DIQMTQSPSSLSASVGDRVTITCRASQFISTYLNWYQQKPGKAPKLLIYDASSLPSGVPSRFSGSGSGTDFTLTISSLQPEDFATYYCQQSYSTSWTFGQGTKVEIK

SEQ ID NO: 112 - protein, 127 aa, Artificial Sequence
  Made in lab - synthesized chain
QVQLVQSGAEVKKPGASVKVSCKASGYTFTNYYMHWVRQAPGQGLEWMGRIKPNSGNTGYAQKFQGRVTMTRDTSTSTVYMELSSLRSEDTAVYYCARGRRSRGSSSLGYYYYMDVWGKGTTVTVSS

SEQ ID NO: 113 - protein, 112 aa, Artificial Sequence
  Made in lab - synthesized chain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQSLEAPLAFGQGTKLEIK

SEQ ID NO: 114 - protein, 123 aa, Artificial Sequence
  Made in lab - synthesized chain
QVQLVQSGAEVKKPGASVKVSCKASGYTFSRYFMHWVRQAPGQGLEWMGWINPNSGGTRYAQNLQGRVTMTRDTSTSTVYMELSSLRSEDTAVYYCARDQKGKSSSWFRFDPWGQGTLVTVSS

SEQ ID NO: 115 - protein, 107 aa, Artificial Sequence
  Made in lab - synthesized chain
DIQMTQSPSSLSASVGDRVTITCRASQDIYRYLNWYQQKPGKAPKLLIFAASSLHSGVPSRFSGSGSGTDFTLTISSLQPEDFATYYCQQSYTTPITFGQGTKVEIK

SEQ ID NO: 116 - protein, 119 aa, Artificial Sequence
  Made in lab - synthesized chain
QVQLVQSGAEVKKPGASVKVSCKASGYTFTNYKMHWVRQAPGQGLEWMGKINPSSGSTSYAQKFQGRVTMTRDTSTSTVYMELSSLRSEDTAVYYCARSGAGMWYFDLWGRGTLVTVSS

SEQ ID NO: 117 - protein, 107 aa, Artificial Sequence
  Made in lab - synthesized chain
DIQMTQSPSSLSASVGDRVTITCRASQGISNYLAWYQQKPGKAPKLLIYAASSLQRGVPSRFSGSGSGTDFTLTISSLQPEDFATYYCQQSYSTPLTFGGGTKVEIK

SEQ ID NO: 118 - protein, 117 aa, Artificial Sequence
  Made in lab - synthesized chain
QVQLVQSGAEVKKPGASVKVSCKASGYTFRRYPMHWVRQAPGQGLEWMGIINPSGGSTSYAQKFQGRVTMTRDTSTSTVYMELSSLRSEDTAVYYCARDKVGAIDYWGQGTLVTVSS

SEQ ID NO: 119 - protein, 107 aa, Artificial Sequence
  Made in lab - synthesized chain
DIQMTQSPSSLSASVGDRVTITCRASQSISTWLAWYQQKPGKAPKLLIYAASTLQSGVPSRFSGSGSGTDFTLTISSLQPEDFATYYCQQSYSSPLTFGGGTKVEIK

SEQ ID NO: 120 - protein, 117 aa, Artificial Sequence
  Made in lab - synthesized chain
QVQLVQSGAEVKKPGASVKVSCKASGYTFTRYYMHWVRQAPGQGLEWMGIINPSGGSTSYAQKFQGRVTMTRDTSTSTVYMELSSLRSEDTAVYYCARGGSGWLDYWGQGTLVTVSS

SEQ ID NO: 121 - protein, 107 aa, Artificial Sequence
  Made in lab - synthesized chain
DIQMTQSPSSLSASVGDRVTITCRASQSISRWLAWYQQKPGKAPKLLIYAASTLQSGVPSRFSGSGSGTDFTLTISSLQPEDFATYYCQQSFSTPYTFGQGTKVEIK

SEQ ID NO: 122 - protein, 119 aa, Artificial Sequence
  Made in lab - synthesized chain
QVQLVQSGAEVKKPGASVKVSCKASGGTFSSYAISWVRQAPGQGLEWMGRISPNRGGTKYAQKFQGRVTMTRDTSTSTVYMELSSLRSEDTAVYYCARDSWLRGAWGYWGQGTLVTVSS

SEQ ID NO: 123 - protein, 113 aa, Artificial Sequence
  Made in lab - synthesized chain
DIVMTQSPDSLAVSLGERATINCTSSQSVLHSSNKKNYLAWYQQKPGQPPKLLIYWASTRASGVPDRFSGSGSGTDFTLTISSLQAEDVAVYYCQQYHSTPYTFGQGTKVEIK

SEQ ID NO: 124 - protein, 117 aa, Artificial Sequence
  Made in lab - synthesized chain
EVQLLESGGGLVQPGGSLRLSCAASGFTFNNFGMSWVRQAPGKGLEWVSGISASGRNTYYADSVKGRFTISRDNSKNTLYLQMNSLRAEDRAVYYCARETRHGSDYWGQGTLVTVSS

SEQ ID NO: 125 - protein, 113 aa, Artificial Sequence
  Made in lab - synthesized chain
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 126 - protein, 125 aa, Artificial Sequence
  Made in lab - synthesized chain
QVQLVQSGAEVKKPGASVKVSCKASGYTFIGYYMHWVRQAPGQGLEWLGWVNPKNGHTGYAQKFQGRVTMTRDTSTSTVYMELSSLRSEDTAVYYCAKDLEHTGYSSGWAGFDYWGQGTLVTVSS

SEQ ID NO: 127 - protein, 112 aa, Artificial Sequence
  Made in lab - synthesized chain
DIVMTQSPLSLPVTPGEPASISCRSSQSLLHSNGYNYLDWYLQKPGQSPQLLIYGASSLQSGVPDRFSGSGSGTDFTLKISRVEAEDVGVYYCMQGTHWPRTFGQGTKVDIK

SEQ ID NO: 128 - protein, 120 aa, Artificial Sequence
  Made in lab - synthesized chain
QVQLVQSGAEVKKPGASVKVSCKASGYRFTNYYMHWVRQAPGQGLEWMGWISPNSGATNYAQNFQGRVTMTRDTSTSTVYMELSSLRSEDTAVYYCARGGRTTVTTMAYWGQGTLVTVSS

SEQ ID NO: 129 - protein, 107 aa, Artificial Sequence
  Made in lab - synthesized chain
DIQMTQSPSSLSASVGDRVTITCRASQSISSYLNWYQQKPGKAPKLLIYAASSLQSGVPSRFSGSGSGTDFTLTISSLQPEDFATYYCQQSYRTPYTFGQGTKLEIK

SEQ ID NO: 130 - protein, 118 aa, Artificial Sequence
  Made in lab - synthesized chain
EVQLLESGGGLVQPGGSLRLSCAASGFAFSNFAMIWVRQAPGKGLEWVSAISGSGGSTYYADSVKGRFTISRDNSKNTLYLQMNSLRAEDTAVYYCARLRANYGMDVWGQGTTVTVSS

SEQ ID NO: 131 - protein, 107 aa, Artificial Sequence
  Made in lab - synthesized chain
EIVMTQSPATLSVSPGERATLSCRASQSVSASLAWYQQKPGQAPRLLIYGASTRATGIPARFSGSGSGTEFTLTISSLQSEDFAVYYCHQYFSPPMTFGQGTRLEIK

SEQ ID NO: 132 - protein, 120 aa, Artificial Sequence
  Made in lab - synthesized chain
QVQLVQSGAEVKKPGASVKVSCKASGYTFTEYYMHWVRQAPGQGLEWMGWMNPNSGHAGSAQKFQGRVTMTRDTSTSTVYMELSSLRSEDTAVYYCARGRRSGLSPPAYWGQGTLVTVSS

SEQ ID NO: 133 - protein, 107 aa, Artificial Sequence
  Made in lab - synthesized chain
DIQMTQSPSSLSASVGDRVTITCRASQYIGSYLNWYQQKPGKAPKLLIYAASTLQSGVPSRFSGSGSGTDFTLTISSLQPEDFATYYCQQSYSPPFTFGQGTKVEIK

SEQ ID NO: 134 - protein, 117 aa, Artificial Sequence
  Made in lab - synthesized chain
QVQLVQSGAEVKKPGASVKVSCKASGYTFTNYGISWVRQAPGQGLEWMGWISADNGNTNYAQKFQGRVTMTRDTSTSTVYMELSSLRSEDTAVYYCARGRSGNWKFWGQGTLVTVSS

SEQ ID NO: 135 - protein, 112 aa, Artificial Sequence
  Made in lab - synthesized chain
DIVMTQSPLSLPVTPGEPASISCRSSQSLLHSNGYNYLDWYLQKPGQSPQLLIYKASSLESGVPDRFSGSGSGTDFTLKISRVEAEDVGVYYCMQGTHWPYAFGQGTRLEIK

SEQ ID NO: 136 - protein, 116 aa, Artificial Sequence
  Made in lab - synthesized chain
QVQLVQSGAEVKKPGASVKVSCKASGYTFTSYYMHWVRQAPGQGLELMGWINPNSGNTKYAQKFQGRVTMTRDTSTSTVYMELSSLRSEDTAVYYCARGSNGMDVWGQGTTVTVSS

SEQ ID NO: 137 - protein, 107 aa, Artificial Sequence
  Made in lab - synthesized chain
DIQMTQSPSSLSASVGDRVTITCRASQSINNWLAWYQQKPGKAPKLLIYKASSLESGVPSRFSGSGSGTDFTLTISSLQPEDFATYYCQQANTFPITFGQGTRLEIK

SEQ ID NO: 138 - protein, 116 aa, Artificial Sequence
  Made in lab - synthesized chain
EVQLLESGGGLVQPGGSLRLSCAASGFSFSNYAMSWVRQAPGKGLEWVSAISGSGRTTYYADSVKGRFTISRDNSKNTLYLQMNSLRAEDTAVYYCARRTSSFSLWGQGTLVTVSS

SEQ ID NO: 139 - protein, 113 aa, Artificial Sequence
  Made in lab - synthesized chain
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKLEIK

SEQ ID NO: 140 - protein, 121 aa, Artificial Sequence
  Made in lab - synthesized chain
QVQLVQSGAEVKKPGSSVKVSCKASAGTFSNYAISWVRQAPGQGLEWMGGIIPIFDATNYAQKFQGRVTITADESTSTAYMELSSLRSEDTAVYYCARRQYSGYDTHFDYWGQGTLVTVSS

SEQ ID NO: 141 - protein, 108 aa, Artificial Sequence
  Made in lab - synthesized chain
EIVMTQSPATLSVSPGERATLSCRASQSVDSSYLAWYQQKPGQAPRLLIYAASARAAGIPARFSGSGSGTEFTLTISSLQSEDFAVYYCQQYYRSPPTFGQGTRLEIK

SEQ ID NO: 142 - protein, 121 aa, Artificial Sequence
  Made in lab - synthesized chain
QVQLVQSGAEVKKPGASVKVSCKASGYRFTSYYLHWVRQAPGQGLEWMGWMNPKSGGTNYAQKFQGRVTMTRDTSTSTVYMELSSLRSEDTAVYYCARGGRSYGYWYFDLWGRGTLVTVSS

SEQ ID NO: 143 - protein, 107 aa, Artificial Sequence
  Made in lab - synthesized chain
DIQMTQSPSSLSASVGDRVTITCRASQSISSWLAWYQQKPGKAPKLLIYAASSLQSGVPSRFSGSGSGTDFTLTISSLQPEDFATYYCQQSYSTPLTFGGGTKVEIK

SEQ ID NO: 144 - protein, 117 aa, Artificial Sequence
  Made in lab - synthesized chain
QVQLVQSGAEVKKPGASVKVSCKASGYTFTRHYMHWVRQAPGQGLEWMGIINPSGGSTSYAQKFQGRVTMTRDTSTSTVYMELSSLRSEDTAVYYCARGSLGYFDLWGRGTLVTVSS

SEQ ID NO: 145 - protein, 106 aa, Artificial Sequence
  Made in lab - synthesized chain
DIQMTQSPSSLSASVGDRVTITCRASQDISRYLAWYQQKPGKAPKLLIYAASTVESGVPSRFSGSGSGTDFTLTISLQPEDFATYYCQQSYRSPYTFGQGTKLEIK

SEQ ID NO: 146 - protein, 119 aa, Artificial Sequence
  Made in lab - synthesized chain
QVQLVQSGAEVKKPGASVKVSCKASGYTFTSYYMHWVRQAPGQGLEWMGWINPNTGGTKSAQKFQGRVTMTRDTSTSTVYMELSSLRSEDTAVYYCARVLRGSLGFDYWGQGTLVTVSS

SEQ ID NO: 147 - protein, 106 aa, Artificial Sequence
  Made in lab - synthesized chain
DIQMTQSPSSLSASVGDRVTITCRASQGISNNLNWYQQKPGKAPKLLIYAASTLQSGVPSRFSGSGSGTDFTLTISSLQPEDFATYYCQQSYSTPTFGQGTKVEIK

SEQ ID NO: 148 - protein, 120 aa, Artificial Sequence
  Made in lab - synthesized chain
QVQLVQSGAEVKKPGASVKVSCKASGYTFTSYGVSWVRQAPGQGLEWMGIINPRGGSTSYAQNFQGRVTMTRDTSTSTVYMELSSLRSEDTAVYYCARYSSSWSWPFDYWGQGTLVTVSS

SEQ ID NO: 149 - protein, 107 aa, Artificial Sequence
  Made in lab - synthesized chain
DIQMTQSPSSLSASVGDRVTITCRASQGISNYLAWYQQKPGKAPKLLIYAASSLQSGVPSRFSGSGSGTDFTLTISSLQPEDFATYYCQQGSSFPLTFGQGTKVDIK

SEQ ID NO: 150 - protein, 119 aa, Artificial Sequence
  Made in lab - synthesized chain
QVQLVQSGAEVKKPGASVKVSCKASGGTFSGYYMHWVRQAPGQGLEWMGWINPNRGGTSYAQNFQGRVTMTRDTSTSTVYMELSSLRSEDTAVYYCARGMYSSSWLRYWGQGTLVTVSS

SEQ ID NO: 151 - protein, 112 aa, Artificial Sequence
  Made in lab - synthesized chain
EVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPYTFGGGTKLEIK

SEQ ID NO: 152 - protein, 121 aa, Artificial Sequence
  Made in lab - synthesized chain
EVQLVESGGGLVQPKGSLKLSCAASGFSFNTYAMNWVRQAPGKGLEWVARIRSKSNNYATYYADSVKDRFTISRDDSESMLYLQMNNLKTEDTAMYYCVRPRYDYWYFDVWGTGTTVTVSS

SEQ ID NO: 153 - protein, 108 aa, Artificial Sequence
  Made in lab - synthesized chain
ENVLTQSPAIMAASLGQKVTMTCSASSSVSSSFLHWYQQKSGASPKPLIHRTSNLASGVPARFSGSGSGTSYSLTISSVEAEDDATYYCQQWSGYPYTFGGGTKLEIK

SEQ ID NO: 154 - protein, 117 aa, Artificial Sequence
  Made in lab - synthesized chain
DVKLVESGEGLVKPGGSLKLSCAASGFTFSSYAMSWVRQTPEKRLEWVAYISSGGDYIYYVDTVKGRFTISRDNARNTLYLQMSSLKSEDTAVYYCTREGTGGMDYWGQGTSVTVSS

SEQ ID NO: 155 - DNA, 648 bp, Artificial Sequence
  Made in lab - synthesized variable light chain polynucleotide sequence
cagagcgtgttaacccagcccgccagcgtgagcggcagccccggccagagcatcaccatcagctgcgccggcaccagcagcgacgtgggcggctacaactacgtgagctggtaccagcagcaccccggcaaggcccccaagctgatgatctacgaggacagcaagagacccagcggcgtgagcaacagattcagcggcagcaagagcggcaacaccgccagcctgaccatcagcggcctgcaggccgaggacgaggccgactactactgcagcagctacaccaccagaagcaccagagtgttcggcggcggcaccaagctggccgtgctgggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 156 - protein, 216 aa, Artificial Sequence
  Made in lab - synthesized variable light chain polypetide sequence
QSVLTQPASVSGSPGQSITISCAGTSSDVGGYNYVSWYQQHPGKAPKLMIYEDSKRPSGVSNRFSGSKSGNTASLTISGLQAEDEADYYCSSYTTRSTRVFGGGTKLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 157 - DNA, 1353 bp, Artificial Sequence
  Made in lab - synthesized anti-beta-Gal Heavy chain IgG1-LALAPG construct
gaggtgcagctggtggagagcggcggcagcctggtgaagcccggcggcagcctgagactgagctgcgccgccagcggcttcaccttcagcaactacagcatgaactgggtgagacaggcccccggcaagggcctggagtggatcagcagcatcagcggcagcagcagatacatctactacgccgacttcgtgaagggcagattcaccatcagcagagacaacgccaccaacagcctgtacctgcagatgaacagcctgagagccgaggacaccgccgtgtactactgcgtgagaagcagcatcaccatcttcggcggcggcatggacgtgtggggcagaggcaccctggtgaccgtgagcagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 158 - protein, 451 aa, Artificial Sequence
  Made in lab - synthesized anti-beta-Gal Heavy chain IgG1-LALAPG construct construct
EVQLVESGGSLVKPGGSLRLSCAASGFTFSNYSMNWVRQAPGKGLEWISSISGSSRYIYYADFVKGRFTISRDNATNSLYLQMNSLRAEDTAVYYCVRSSITIFGGGMDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - DNA, 1341 bp, Artificial Sequence
  Made in Lab - Synthesized anti-Beta-Gal Heavy chain IgG2 polynucleotide sequence
gaggtgcagctggtggagagcggcggcagcctggtgaagcccggcggcagcctgagactgagctgcgccgccagcggcttcaccttcagcaactacagcatgaactgggtgagacaggcccccggcaagggcctggagtggatcagcagcatcagcggcagcagcagatacatctactacgccgacttcgtgaagggcagattcaccatcagcagagacaacgccaccaacagcctgtacctgcagatgaacagcctgagagccgaggacaccgccgtgtactactgcgtgagaagcagcatcaccatcttcggcggcggcatggacgtgtggggcagaggcaccctggtgaccgtgagcagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 160 - protein, 447 aa, Artificial Sequence
  Made in Lab - Synthesized anti-Beta-Gal Heavy chain IgG2 polypeptide sequence
EVQLVESGGSLVKPGGSLRLSCAASGFTFSNYSMNWVRQAPGKGLEWISSISGSSRYIYYADFVKGRFTISRDNATNSLYLQMNSLRAEDTAVYYCVRSSITIFGGGMDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 161 - DNA, 702 bp, Artificial Sequence
  Made in Lab - Synthesized Anti-ASGR1 VH-CH1 polynucleotide sequence
gaagtgcagctgctggaatccgggggcggactggtgcaacccgggggatccctcagactgtcctgtgccgcatcgggtttcactttctcctcctacgcgatgtcatgggtcagacaggcccctggaaaaggcctcgaatgggtgtcggctatctccggatcggggggatctacttactacgccgactccgtgaagggccggttcactatctcgagggacaactccaagaataccctgtacttgcaaatgaactccctgcgcgccgaggataccgcggtgtattactgcgccaaggacttcagctcacgccggtggtaccttgagtactggggacagggaacccttgtcaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtggatccggctccggacatcatcatcaccatcac

SEQ ID NO: 162 - protein, 234 aa, Artificial Sequence
  Made in Lab - Synthesized Anti-ASGR1 VH-CH1 polynpeptide sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDFSSRRWYLEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSGSGHHHHHH

SEQ ID NO: 163 - DNA, 765 bp, Artificial Sequence
  Synthesized murine ASGR1 Extracellular domain - polynucleotide
caaaattcccaactccgggaagatctgctggctctaaggcagaatttcagcaacctcactgtgagcactgaggaccaggtcaaggccctgagcacccagggaagtagtgtgggaagaaagatgaagttagtggagtcgaagctggaaaaacagcagaaggatctgactgaagatcactccagtttgctactgcacgtgaagcagttagtgtctgacgtgcgaagcttgagctgccagatggctgcatttcggggcaatggctctgaaaggacctgctgccccatcaactgggtggagtatgaaggcagctgctactggttctccagctctgtgaggccttggactgaagctgacaagtactgccagctggaaaatgcccatctggtggtggtgacctccagggatgagcagaacttcctccagcgccacatgggccccttaaacacttggattggcctaactgaccagaacgggccctggaaatgggtggatggaacagactacgagacaggcttccagaattggagaccagagcagccagataactggtacggacatgggcttggaggaggcgaggactgtgcccacttcacgacggatggccgctggaatgacgacgtctgcaggaggccctaccgctgggtctgtgagacaaagttggataaggctaattccggctccggaggtcttaatgatattttcgaggctcagaagattgagtggcatgaaggatccggctcccaccaccatcatcaccaccaccac

SEQ ID NO: 164 - protein, 255 aa, Artificial Sequence
  Synthesized murine ASGR1 Extracellular domain - polypeptide
QNSQLREDLLALRQNFSNLTVSTEDQVKALSTQGSSVGRKMKLVESKLEKQQKDLTEDHSSLLLHVKQLVSDVRSLSCQMAAFRGNGSERTCCPINWVEYEGSCYWFSSSVRPWTEADKYCQLENAHLVVVTSRDEQNFLQRHMGPLNTWIGLTDQNGPWKWVDGTDYETGFQNWRPEQPDNWYGHGLGGGEDCAHFTTDGRWNDDVCRRPYRWVCETKLDKANSGSGGLNDIFEAQKIEWHEGSGSHHHHHHHH

SEQ ID NO: 165 - protein, 111 aa, Artificial Sequence
  Made in lab - synthesized variable light chain sequence
DIVMTQSPDSLAVSLGERATINCRASESVDSYGNSFMHWYQQKPGQPPKLLIYLASNLESGVPDRFSGSGSGTDFTLTISSLQAEDVAVYYCQQNNEDPLTFGQGTKVEIK

SEQ ID NO: 166 - protein, 118 aa, Artificial Sequence
  Made in lab - synthesized variable heavy chain sequence
QVQLVQSGAEVKKPGASVKVSCKASGFNIKDTYIHWVRQAPGQGLEWMGRIDPANGKANYDPKFQGRVTMTRDTSTSTFYMELSSLRSEDTAVYYCALGGGYYGMDYWGQGTLVTVSS

SEQ ID NO: 167 - protein, 107 aa, Artificial Sequence
  Made in lab - synthesized variable light chain sequence
DIVMTQSQKFMSTSVGDRVSITCKASQSVRPAVAWYQQKPGQSPKALIYLASNRHTGVPDRFTGSGSGTDFTLTISNVQSEDLADYFCLQHWNYPYTFGGGTKLEIK

SEQ ID NO: 168 - protein, 117 aa, Artificial Sequence
  Made in lab - synthesized variable heavy chain sequence
EVQLQQSGAELVRPGASVKLSCTASGFNIKDDYIHWVKQRPEQGLEWIGWIDPENGDTKYASKFPGKATMTADTSSNTAYLQLSSLTSEDTAVYYCTASRTTALDYWGPGTTLTVSS

SEQ ID NO: 169 - protein, 108 aa, Artificial Sequence
  Made in lab - synthesized variable light chain sequence
DIELTQPPSVSVSPGQTASITCSGDSLGSYYVHWYQQKPGQAPVLVIYRNKQRPSGIPERFSGSNSGNTATLTISGTQAEDEADYYCQTYDWMYSSRVFGGGTKLTVL

SEQ ID NO: 170 - protein, 121 aa, Artificial Sequence
  Made in lab - synthesized variable heavy chain sequence
EVQLVESGGGLVKPGGSLRLSCAASGFTFSDYGIHWVRQAPGKGLEWVGRIKSKTDGGITEYAAPVKGRFTISRDDSKNTLYLQMNSLKTEDTAVYYCARAIYYLEAFDVWGQGTLVTVSS

SEQ ID NO: 171 - protein, 109 aa, Artificial Sequence
  Made in lab - synthesized variable light chain sequence
DIELTQDPAVSVALGQTVRITCQGDSLRSYYASWYQQKPGQAPVLVIYGKNNRPSGIPDRFSGSSSGNTASLTITGAQAEDEADYYCNSLERIGYLSYVFGGGTKLTVL

SEQ ID NO: 172 - protein, 109 aa, Artificial Sequence
  Made in lab - synthesized variable light chain sequence
SSELTQDPAVSVALGQTVRITCQGDSLRSYYASWYQQKPGQAPVLVIYGKNNRPSGIPDRFSGSSSGNTASLTITGAQAEDEADYYCNSLERIGYLSYVFGGGTKLTVL

SEQ ID NO: 173 - protein, 120 aa, Artificial Sequence
  Made in lab - synthesized variable heavy chain sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDFSSRRWYLEYWGQGTLVTVSS

SEQ ID NO: 174 - protein, 108 aa, Artificial Sequence
  Made in lab - synthesized variable light chain sequence
SSELTQDPAVSVALGQTVRITCQGDSLRSYYASWYQQKPGQAPVLVIYGKNNRPSGIPDRFSGSSSGNTASLTITGAQAEDEADYYCNSRLRSGKMVVFGGGTKLTVL

SEQ ID NO: 175 - protein, 120 aa, Artificial Sequence
  Made in lab - synthesized variable heavy chain sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSWYLPGRGFDYWGQGTLVTVSS

SEQ ID NO: 176 - protein, 108 aa, Artificial Sequence
  Made in lab - synthesized variable light chain sequence
SSELTQDPAVSVALGQTVRITCQGDSLRSYYASWYQQKPGQAPVLVIYGKNNRPSGIPDRFSGSSSGNTASLTITGAQAEDEADYYCNSRKSSSKNVVFGGGTKLTVL

SEQ ID NO: 177 - protein, 120 aa, Artificial Sequence
  Made in lab - synthesized variable heavy chain sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSSFTFGRYFDYWGQGTLVTVSS

SEQ ID NO: 178 - protein, 107 aa, Artificial Sequence
  Made in lab - synthesized variable light chain sequence
SSELTQDPAVSVALGQTVRITCQGDSLRSYYASWYQQKPGQAPVLVIYGRNNRPSGIPDRFSGSSSGNTASLTITGAQAEDEADYYCNSRDRRGYSVFGGGTKLTVL

SEQ ID NO: 179 - protein, 120 aa, Artificial Sequence
  Made in lab - synthesized variable heavy chain sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSSFSYLRAFDYWGQGTLVTVSS

SEQ ID NO: 180 - protein, 119 aa, Artificial Sequence
  Made in lab - synthesized variable heavy chain sequence
QVQLQQSGPELVRPGVSVKISCKGSGYTFTDYAMHWVKQSHAKSLEWIGGISTYFGRTNYNQKFKGRATMTVDKSSSTAYMELARLTSEDSALYYCARGLSGNYVMDYWGQGTSVTVSS

SEQ ID NO: 181 - protein, 111 aa, Artificial Sequence
  Made in lab - synthesized variable light chain sequence
DIVLFQSPASLAVSLGQRATISCRASESVDDYGNSFMHWYQQKPGQPPKLLIYRASNLESGIPARFSGSGSRTDFTLTINPVEADDVATYYCQQSNEAPPTFGGGTKLEIK

SEQ ID NO: 182 - protein, 117 aa, Artificial Sequence
  Made in lab - synthesized variable heavy chain sequence
EVQLLESGGGLVQPGGSLRLSCAASGFTFSNAWMSWVRQAPGKGLEWVSYISSSGSTIYYADSVKGRFTISRDNSKNTLYLQMNSLRAEDTAVYYCAREGLWAFDYWGQGTLVTVTS

SEQ ID NO: 183 - protein, 111 aa, Artificial Sequence
  Made in lab - synthesized variable light chain sequence
QSVLTQPPSASGTPGQRVTISCTGSSSNIGAGYVVHWYQQLPGTAPKLLIYDNNKRPSGVPDRFSGSKSGTSASLAISGLASEDEADYYCAAWDDRLNGPVFGGGTKLTVL

SEQ ID NO: 184 - protein, 123 aa, Artificial Sequence
  Made in lab - synthesized variable heavy chain sequence
EVQLQQSGTVLARPGASVKMSCKASGYTFASYWIHWVKQRPGQGLEWIGSIYPGNSDTTYNQKFKGKAKLTVVTSASSAYMELSSLTNEDSAVYYCTEPTYYSYDDYYAMDYWGQGTSVTVSS

SEQ ID NO: 185 - protein, 108 aa, Artificial Sequence
  Made in lab - synthesized variable light chain sequence
EIVLTQSPALMAASPGEKVTITCSVSSSISSSNLHWYQQKSGTSPKPWIYGTSNLASGVPVRFSGSGSGTSYSLTISTMEAEDAATYYCQQWSSYPLTFGAGTKLELK

SEQ ID NO: 186 - DNA, 1707 bp, Artificial Sequence
  Made in lab - synthesized Anti-beta-Gal Heavy chain IgG2, RSPO2 (F105R/F109A) polynucleotide  sequence
gaggtgcagctggtggagagcggcggcagcctggtgaagcccggcggcagcctgagactgagctgcgccgccagcggcttcaccttcagcaactacagcatgaactgggtgagacaggcccccggcaagggcctggagtggatcagcagcatcagcggcagcagcagatacatctactacgccgacttcgtgaagggcagattcaccatcagcagagacaacgccaccaacagcctgtacctgcagatgaacagcctgagagccgaggacaccgccgtgtactactgcgtgagaagcagcatcaccatcttcggcggcggcatggacgtgtggggcagaggcaccctggtgaccgtgagcagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 187 - protein, 569 aa, Artificial Sequence
  Made in lab - synthesized Anti-beta-Gal Heavy chain IgG2, RSPO2 (F105R/F109A) polypeptide  sequence
EVQLVESGGSLVKPGGSLRLSCAASGFTFSNYSMNWVRQAPGKGLEWISSISGSSRYIYYADFVKGRFTISRDNATNSLYLQMNSLRAEDTAVYYCVRSSITIFGGGMDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 188 - DNA, 1707 bp, Artificial Sequence
  Made in lab - synthesized Anti-GFP Heavy chain IgG2, RSPO2 (F105R/F109A) polynucleotide sequence
caggtccagttggtggaatccggagggggtttggtccagcctggtggaagcctgcgcctctcatgcgccgctagcggattcaccttctcccgatacggcatgcattgggtcagacaggcacccggaaaaggactcgaatgggtgtcgggcatttcctcgatcgggtcaaacacctattacgccgactccgtgaagggacggttcaccattagccgggataacagcaagaacactctgtacttgcaaatgaactccctgcgggctgaggacaccgccgtgtactactgtgcgcggtggtacaagacctatattgacgtctggggacagggtaccctcgtgaccgtgtctagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 189 - protein, 569 aa, Artificial Sequence
  Made in lab - synthesized Anti-GFP Heavy chain IgG2, RSPO2 (F105R/F109A) polypeptide sequence
QVQLVESGGGLVQPGGSLRLSCAASGFTFSRYGMHWVRQAPGKGLEWVSGISSIGSNTYYADSVKGRFTISRDNSKNTLYLQMNSLRAEDTAVYYCARWYKTYIDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 190 - DNA, 657 bp, Artificial Sequence
  Made in lab - synthesized LP1-1F8 light chain polynucleotide sequence
gacattgtgatgtcacagtctccatcctccctggctgtgtcagcaggagagaaggtcactatgagctgcaagtccagtcagagtctgttcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttattatctgctcacgttcggtgctgggaccaagctggagctgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 191 - protein, 219 aa, Artificial Sequence
  Made in lab - synthesized LP1-1F8 light chain polypeptide sequence
DIVMSQSPSSLAVSAGEKVTMSCKSSQSLFNSRTRKNYLAWYQQKPGQSPKLLIYWASTRESGVPDRFTGSGSGTDFTLTISSVQAEDLAVYYCKQSYYLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 192 - DNA, 1707 bp, Artificial Sequence
  Made in lab - synthesized LP1-1F8 Heavy chain IgG2, RSPO2 (F105R/F109A) polynucleotide sequence
gaagtgaaactggtggagtctgggggaggcttagtgaagcctggagggtccctgaaactctcctgtgcagcctctggattcactttcagtacctataccatgtcttgggttcgccagactccggcgaagaggctggagtgggtcgcaaccattagtagtattggtgttaacacctactatccagacagtgtgaagggccgattcaccatctccagagacaatgccaggaacaccctgtacctgcaagtgagcagtctgaggtctgaggacacggccatgtattactgtgcaagacatgtggattactacgatgggatttcctttgactactggggccaaggcaccactctcacagtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 193 - protein, 569 aa, Artificial Sequence
  Made in lab - synthesized LP1-1F8 Heavy chain IgG2, RSPO2 (F105R/F109A) polypeptide sequence
EVKLVESGGGLVKPGGSLKLSCAASGFTFSTYTMSWVRQTPAKRLEWVATISSIGVNTYYPDSVKGRFTISRDNARNTLYLQVSSLRSEDTAMYYCARHVDYYDGISFDYWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 194 - DNA, 642 bp, Artificial Sequence
  Made in lab - synthesized LP1-1N15 light chain polynucleotide sequence
gacatcaagatgacccagtctccatcttccatgtatgcatctctaggagagagagttactatcacttgcaaggcgagtcaggacattaatagccatttaagctggttccagcagaaaccagggaaatctcctaagaccctgatcattcgtgcaaacagattggtagatggggtcccatcaaggttcagtggcagtggatctgggcaagattattctctcaccatcagcagcccggagtatgaagaaatgggaatttattactgtctacagtatgatgagtttccgttcacgttcggaggggggaccaagctggaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 195 - protein, 214 aa, Artificial Sequence
  Made in lab - synthesized LP1-1N15 light chain polypeptide sequence
DIKMTQSPSSMYASLGERVTITCKASQDINSHLSWFQQKPGKSPKTLIIRANRLVDGVPSRFSGSGSGQDYSLTISSPEYEEMGIYYCLQYDEFPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 196 - DNA, 1683 bp, Artificial Sequence
  Made in lab - synthesized LP1-1N15 Heavy chain IgG2, RSPO2 (F105R/F109A) polynucleotide sequence
gaggtccagctgcaacagtctggacctgagctggtgaagcctggggcttcagtgaagatgtcctgtaaggcttctggatacacattcactgactactacatgaactgggtgaagcagagtcatggagagagccttgagtggattggacgtgttattcctagcaatggtggtactaactacaaccagaagttcaagggcaaggccacattgacagtagacaaatccctcaccacagcctacatgcagctcaacagcctgacatctgaagactctgcggtctatttctgtgcaagagggatggactactggggtccaggaacctcagtcaccgtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 197 - protein, 561 aa, Artificial Sequence
  Made in lab - synthesized LP1-1N15 Heavy chain IgG2, RSPO2 (F105R/F109A) polypeptide sequence
EVQLQQSGPELVKPGASVKMSCKASGYTFTDYYMNWVKQSHGESLEWIGRVIPSNGGTNYNQKFKGKATLTVDKSLTTAYMQLNSLTSEDSAVYFCARGMDYWGPGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 198 - DNA, 642 bp, Artificial Sequence
  Made in lab - synthesized LP1-1P13 light chain polynucleotide sequence
gacatccagatgactcagtctccagcctccctatctgcatctgtgggacaaactgttatcatcacatgtcgaacaagtgagaatatttacagtaatttagcatggtatcagcagaaacagggaaaatctcctcagctcctggtctatgctgcaacaaacttagcagatggtgtgccatcaaggttcagtggcagtggttcaggcacacagtattacctcaagatcaacagcctgcagtctgaagattttgggagttattactgtcaacatttttggggtagtacgtggacgttcggtggaggcaccaagctggacatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 199 - protein, 107 aa, Artificial Sequence
  Made in lab - synthesized LP1-1P13 light chain polypeptide sequence
DIQMTQSPASLSASVGQTVIITCRTSENIYSNLAWYQQKQGKSPQLLVYAATNLADGVPSRFSGSGSGTQYYLKINSLQSEDFGSYYCQHFWGSTWTFGGGTKLDIK

SEQ ID NO: 200 - DNA, 1707 bp, Artificial Sequence
  Made in lab - synthesized LP1-1P13 Heavy chain IgG2, RSPO2 polynucleotide sequence
gaggttcaactgcagcagtctggacctgaactggtgaagcctggggcttcagtgaagatatcctgcaaggcttctggttactcatttactgactactttatgaactgggtgaagcagagccatggaaagagccttgagtggattggacgttttaatcctttcaatggtcaaactttctacaatcaggagttcaagggcaaggccacattaactgtagacaaatcctctagcaccgcccacatggagctccggagcctgacatctgaggactctgcagtctattattgtgcaagaagaggaaggtacgacgtttactatgttctggactactggggtcaaggaacctcagtcaccgtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 201 - protein, 569 aa, Artificial Sequence
  Made in lab - synthesized LP1-1P13 Heavy chain IgG2, RSPO2 polypeptide sequence
EVQLQQSGPELVKPGASVKISCKASGYSFTDYFMNWVKQSHGKSLEWIGRFNPFNGQTFYNQEFKGKATLTVDKSSSTAHMELRSLTSEDSAVYYCARRGRYDVYYVLDYWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 202 - DNA, 642 bp, Artificial Sequence
  Made in lab - synthesized LP1-1P5 light chain polynucleotide sequence
gacattgtgatgacccagtctcaaaaattcatgtccacatcagtaggagacagggtcagcgtcacctgcaaggccagtcagaatgtgggtactaatgtagcctggtatcaacagaaaccaggacaatctcctaaagcactgatttactcggcatcttatcggtacagtggagtccctgatcgcttcacaggcagtggatctgggacagatttcactctcaccatcagcaatgtgcagtctgaagacttggcagagtatttctgtcaacaatataacagctatccgctcacgttcggtgctgggaccaagctggagctgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 203 - protein, 214 aa, Artificial Sequence
  Made in lab - synthesized LP1-1P5 light chain polpeptide sequence
DIVMTQSQKFMSTSVGDRVSVTCKASQNVGTNVAWYQQKPGQSPKALIYSASYRYSGVPDRFTGSGSGTDFTLTISNVQSEDLAEYFCQQYNSYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204 - DNA, 1704 bp, Artificial Sequence
  Made in lab - synthesized LP1-1P5 Heavy chain IgG2, RSPO2 (F105R/F109A) polynucleotide  sequence
caggtccagctgcagcaatctggacctgagctggtgaggcctgggacttcagtgaagatatcctgcaaggcttctggctataccttcctcacctactggatgaactgggtgaagcagaggcctggacagggccttgagtggattggacagattttccctgcaactggtattacttactacagtgagatgttcaaggacaaggccacattgactgaagacacatcctccaccacagcctacatgcaactcagcagcctgacatctgaggccactgctgtctatttctgtgcaagaagaagggcctaccatagtaacttttttgactactggggccaaggcaccactctcacagtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 205 - protein, 568 aa, Artificial Sequence
  Made in lab - synthesized LP1-1P5 Heavy chain IgG2, RSPO2 (F105R/F109A) polypeptide sequence
QVQLQQSGPELVRPGTSVKISCKASGYTFLTYWMNWVKQRPGQGLEWIGQIFPATGITYYSEMFKDKATLTEDTSSTTAYMQLSSLTSEATAVYFCARRRAYHSNFFDYWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 206 - DNA, 657 bp, Artificial Sequence
  Made in lab - synthesized LP1-2E12 light chain polynucleotide sequence
gatgttgtggtgactcaaactccactctccctgcctgtcagctttggagatcgagtttctatctcttgcaggtctagtcagagtcttgcaaacagttatgggaacacctatttgtcttggtacctgcacaagcctggccagtctccacagctcctcatctatgggatttccaacagattttctggggtgccagacaggttcagtggcagtggttcagggacagatttcacactcaagatcagcacaataaagcctgaggacttgggaatgtattactgcttacaaggtacacatcagcctctcacgttcggtgctgggaccaagctggagctgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 207 - protein, 219 aa, Artificial Sequence
  Made in lab - synthesized LP1-2E12 light chain polypeptide sequence
DVVVTQTPLSLPVSFGDRVSISCRSSQSLANSYGNTYLSWYLHKPGQSPQLLIYGISNRFSGVPDRFSGSGSGTDFTLKISTIKPEDLGMYYCLQGTHQPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 208 - DNA, 1689 bp, Artificial Sequence
  Made in lab - synthesized LP1-2E12 Heavy chain IgG2, RSPO2 (F105R/F109A) polynucleotide sequence
gatgtacaacttcaggagtcaggacctggcctcgtgaaaccttctcagtctctgtctctcacctgctctgtcactggctactccatcaccagtggttattactggaactggatccggcagtttccaggaaacaaactggaatggatgggctccataggctacgatgataccaatcactacaacccatctctcaaaaatcgaatctccatcactcgtgacacatctaagaaccagtttttcctgaagttgaattctgtgacaactgaggacacagccacatattactgtgcaggtgactacccctttgctttctggggccaagggactctggtcactgtctctgcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 209 - protein, 563 aa, Artificial Sequence
  Made in lab - synthesized LP1-2E12 Heavy chain IgG2, RSPO2 (F105R/F109A) polypeptide sequence
DVQLQESGPGLVKPSQSLSLTCSVTGYSITSGYYWNWIRQFPGNKLEWMGSIGYDDTNHYNPSLKNRISITRDTSKNQFFLKLNSVTTEDTATYYCAGDYPFAFWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 210 - DNA, 639 bp, Artificial Sequence
  Made in lab - synthesized LP1-2I13 light chain polynucleotide sequence
gacatccagatgactcagtctccagcctccctatctgcatctgtgggagaaactgtcaccatcacatgtcgagcaagtgagaatatttacagttatttagtatggtatcagcagaaacagggaaaatctcctcagctcctggtctataatgcaaaaaccttagcagaaggtgtgccatcaaggttcagtggcagtggatcaggcacacagttttctctgaagatcaacagcctgcagcctgaagattttgggagttattactgtcaacatcattatggtacttggacgttcggtggaggcataaagctggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 211 - protein, 213 aa, Artificial Sequence
  Made in lab - synthesized LP1-2I13 light chain polypeptide sequence
DIQMTQSPASLSASVGETVTITCRASENIYSYLVWYQQKQGKSPQLLVYNAKTLAEGVPSRFSGSGSGTQFSLKINSLQPEDFGSYYCQHHYGTWTFGGGIKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 212 - DNA, 1716 bp, Artificial Sequence
  Made in lab - synthesized LP1-2I13 Heavy chain IgG2, RSPO2 (F105R/F109A) polynucleotide sequence
gaggtgcagctggtggagtctgggggaggcttagtgaagcctggagggtcccggaaactctcctgtgcagcctctggattcactttcagtgactatggaatgcactgggtccgtcaggctccagagaaggggctggagtgggttgcctacattagtagtggcagtagtaccatctactatgcagacacagtgaagggccgattcaccatctccagagacaatgccaagaacaccctgttcctacaaatgaccagtctaaggtctgaggacacagccatgtattactgttcaaggaagggagggtttggtgactacgagaaaagctatgctatggactactggggtcaaggaacctcagtcaccgtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 213 - protein, 572 aa, Artificial Sequence
  Made in lab - synthesized LP1-2I13 Heavy chain IgG2, RSPO2 (F105R/F109A) polypeptide sequence
EVQLVESGGGLVKPGGSRKLSCAASGFTFSDYGMHWVRQAPEKGLEWVAYISSGSSTIYYADTVKGRFTISRDNAKNTLFLQMTSLRSEDTAMYYCSRKGGFGDYEKSYAMDYWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 214 - DNA, 642 bp, Artificial Sequence
  Made in lab - synthesized LP1-2I22 light chain polynucleotide sequence
gacatccagatgactcagtctccagcctccctatctgcatctgtgggagaaactgttatcatcacatgtcgagcaagtgagaatatttacagtaatttagcatggtatcagcagaaacagggaaaatctcctcagctcctggtctatggtgcaacaaacttagcagatggtgtgacatcaaggttcagtggcagtggttcaggcacacagttttccctcaagatcgacagcctgcagtctgaagattttgggagttattactgtcaacatttttggggtactacgtggacgttcggtggaggcaccaagctggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 215 - protein, 214 aa, Artificial Sequence
  Made in lab - synthesized LP1-2I22 light chain polypeptide sequence
DIQMTQSPASLSASVGETVIITCRASENIYSNLAWYQQKQGKSPQLLVYGATNLADGVTSRFSGSGSGTQFSLKIDSLQSEDFGSYYCQHFWGTTWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - DNA, 1707 bp, Artificial Sequence
  Made in lab - synthesized LP1-2I22 Heavy chain IgG2, RSPO2 (F105R/F109A) polynucleotide sequence
gaggttcaactgcagcagtctggacctgaactggtgaagcctggggcttcagtgaagatatcctgcaaggcttctggttactcatttactggctactttatgaactgggtgaagcagagccatggaaagagccttgagtggattggacgttttaatcctttcaatggtcaaactttctacaatcaggagttcaagggcaaggccacattaactgttgacaaatcctctgacaccgcccacatggaactccggagcctgacatctgaggactctgcagtctattattgtgcaagaagaggaaggtacgacgtttactatgctctggactactggggtcaaggaacctcagtcaccgtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 217 - protein, 569 aa, Artificial Sequence
  Made in lab - synthesized LP1-2I22 Heavy chain IgG2, RSPO2 (F105R/F109A) polypeptide sequence
EVQLQQSGPELVKPGASVKISCKASGYSFTGYFMNWVKQSHGKSLEWIGRFNPFNGQTFYNQEFKGKATLTVDKSSDTAHMELRSLTSEDSAVYYCARRGRYDVYYALDYWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 218 - DNA, 642 bp, Artificial Sequence
  Made in lab - synthesized LP1-3A24 light chain polynucleotide sequence
gacattgtgatgacccagtctcaaaaattcatgtccacatcagtaggagacagggtcagcgtcacctgcaaggccagtcagaatgtgggtagtaatgtagcctggtttcaacagaaaccagggcaatctcctaaagcactgatttactcgtcatcctaccggtacagtggagtccctgatcgcttcacgggcagtggatctgggacagatttcactctcaccatcaccaatgtgcagtctgaagacttggcagagtatttctgtcagcaatataacagctttcctctcacgttcggtgctgggaccaagctggaactgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 219 - protein, 214 aa, Artificial Sequence
  Made in lab - synthesized LP1-3A24 light chain polypeptide sequence
DIVMTQSQKFMSTSVGDRVSVTCKASQNVGSNVAWFQQKPGQSPKALIYSSSYRYSGVPDRFTGSGSGTDFTLTITNVQSEDLAEYFCQQYNSFPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 220 - DNA, 1683 bp, Artificial Sequence
  Made in lab - synthesized LP1-3A24 Heavy chain IgG2, RSPO2 (F105R/F109A) polynucleotide sequence
gaggtccagctgcaacagtctggacctgagctggtgaagcctggggcttcagtgaagatgtcctgtaaggcttctggatacacattcactgactactacataaactgggtgaggcagagtcatggaaagagccttgagtggattggacgtgttattcctagcaatggtggtagtaactacaaccagaagttcaagggcaaggccacattgacagtagacaaatccctcagtacagcctacatgcacctcaacagcctgacatctgaggactctgcggtctattactgtgcaacccagctgggacggtggggccaagggactctggtcactgtctctgcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 221 - protein, 561 aa, Artificial Sequence
  Made in lab - synthesized LP1-3A24 Heavy chain IgG2, RSPO2 (F105R/F109A) polypeptide sequence
EVQLQQSGPELVKPGASVKMSCKASGYTFTDYYINWVRQSHGKSLEWIGRVIPSNGGSNYNQKFKGKATLTVDKSLSTAYMHLNSLTSEDSAVYYCATQLGRWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 222 - DNA, 639 bp, Artificial Sequence
  Made in lab - synthesized LP1-3E20 light chain polynucleotide sequence
gacatcaagatgacccagtctccatcttccatgtatgcatctctaggagagagagtcactatcacttgcaaggcgagtcaggacattaatagctatttaagctggttccagcagaaaccagggaaatctcctaagaccctgatctatcgtgcaaacagattggtagatggggtcccatcaaggttcagtggcagtggatctgggcaagattattctctcaccatcagcagcctagagtatgaagatatgggaatttattattgtctacagtatgatgacttgtggacgttcggtggaggcaccaagctggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 223 - protein, 213 aa, Artificial Sequence
  Made in lab - synthesized LP1-3E20 light chain polypeptide sequence
DIKMTQSPSSMYASLGERVTITCKASQDINSYLSWFQQKPGKSPKTLIYRANRLVDGVPSRFSGSGSGQDYSLTISSLEYEDMGIYYCLQYDDLWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - DNA, 1707 bp, Artificial Sequence
  Made in lab - synthesized LP1-3E20 Heavy chain IgG2, RSPO2 (F105R/F109A) polynucleotide sequence
caggtccaactgcagcagtctggggctgaactggcaaaacctggggcctcagtgaagatgtcctgcaaggcttctggctacacctttactagctactggatacactgggtaaaacagaggcctggacagggtctggaatggattggatacattaatcctagcagtggttatgctgagtacaatcagaagttcaaggtcagggccacattgactgcagacaaatcctccagcacagcctacatgcaactaagcagcctgacatctgaggactctgcagtctattactgtgcaagagaaagttactatagtttcgactatactatggactactggggtcaaggaacctcagtcaccgtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 225 - protein, 569 aa, Artificial Sequence
  Made in lab - synthesized LP1-3E20 Heavy chain IgG2, RSPO2 (F105R/F109A) polypeptide sequence
QVQLQQSGAELAKPGASVKMSCKASGYTFTSYWIHWVKQRPGQGLEWIGYINPSSGYAEYNQKFKVRATLTADKSSSTAYMQLSSLTSEDSAVYYCARESYYSFDYTMDYWGQGTSVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 226 - DNA, 657 bp, Artificial Sequence
  Made in lab - synthesized LP1-6H3 light chain polynucleotide sequence
gatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcacacgttcggctcggggacaaagttggaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 227 - protein, 219 aa, Artificial Sequence
  Made in lab - synthesized LP1-6H3 light chain polypeptide sequence
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPHTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 228 - DNA, 1689 bp, Artificial Sequence
  Made in lab - synthesized LP1-6H3 Heavy chain IgG2, RSPO2 (F105R/F109A) polynucleotide sequence
caggcttatctacagcagtctggggctgagctggtgaggcctggggcctcagtgaagatgtcctgtaaggcttctggctacacattttcccgtttcgatatgcactgggtaaagcagacacctagacagggcctggaatggattggagttatttatccaggaaatggtgatacttcctacaatcagaagttcagggacaaggcctcactgactgtagacaaatcctccagcacagcctacatgcagctcagcagcctgacatctgaagactctgcggtctatttctgtgcaagctcctactatggtaacccctggggccaaggcaccactctcacagtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 229 - protein, 563 aa, Artificial Sequence
  Made in lab - synthesized LP1-6H3 Heavy chain IgG2, RSPO2 (F105R/F109A) polypeptide sequence
QAYLQQSGAELVRPGASVKMSCKASGYTFSRFDMHWVKQTPRQGLEWIGVIYPGNGDTSYNQKFRDKASLTVDKSSSTAYMQLSSLTSEDSAVYFCASSYYGNPWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 230 - DNA, 642 bp, Artificial Sequence
  Made in lab - synthesized LP1-7B13 light chain polynucleotide sequence
gatattgtgctaactcagtctccagccaccctgtctgtgactccaggagatagagtcagtctttcctgcagggccagtcaaagtattagcaactacctacactggtatcaacaaaaatcacatgagtctccaaggcttctcatcaagtttgcttcccagtccatctctgggatcccctccaggttcagtggcagtggatcagggacggatttcactctcactatcaacagtgtggagactgaagattttggaatgtatttctgtcaacagagtaacagctggccgctcacgttcggtgctgggaccaagctggagctgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 231 - protein, 214 aa, Artificial Sequence
  Made in lab - synthesized LP1-7B13 light chain polypeptide sequence
DIVLTQSPATLSVTPGDRVSLSCRASQSISNYLHWYQQKSHESPRLLIKFASQSISGIPSRFSGSGSGTDFTLTINSVETEDFGMYFCQQSNSWPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - DNA, 1689 bp, Artificial Sequence
  Made in lab - synthesized LP1-7B13 Heavy chain IgG2, RSPO2 (F105R/F109A) polynucleotide sequence
gaggtccagctgcaacaatctggacctgaggtggtgaagcctggggcttcagtgaagatgtcctgtaagacttctggattcacattcactgactactacatgaactgggtgaagcagggtcatggaaagagccttgagtggattggacgtgttaatcctagcaatgatgatactaggtacaatcagaagttcaagggaaaggccacattgacagtagacaagtccctcagcacagcctacatgcagctcaacagcctgacatctgaggactctgcggtctattactgtacaaggtggttctactttgactactggggccaaggcactactctcacagtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 233 - protein, 563 aa, Artificial Sequence
  Made in lab - synthesized LP1-7B13 Heavy chain IgG2, RSPO2 (F105R/F109A) polypeptide sequence
EVQLQQSGPEVVKPGASVKMSCKTSGFTFTDYYMNWVKQGHGKSLEWIGRVNPSNDDTRYNQKFKGKATLTVDKSLSTAYMQLNSLTSEDSAVYYCTRWFYFDYWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 234 - DNA, 642 bp, Artificial Sequence
  Made in lab - synthesized LP1-7I20 light chain polynucleotide sequence
gacatccagatgactcagtctccagcctccctatctgcatctgtgggagaaactgtcaccatcacatgtcgaacaagtgagaatatttacagttatttagcatggtatcagcagaaacagggaaaatctcctcagctcctggtctataatgcaaaaaccttagcaaaaggtgtgccatcaaggttcagtggcagtggatcaggcacacagttttctctgaagatcaacggcctgcagcctgaagattttgggaattattactgtcaacatcattatggtactccgtacacgttcggaggggggaccaaggtggaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 235 - protein, 214 aa, Artificial Sequence
  Made in lab - synthesized LP1-7I20 light chain polypeptide sequence
DIQMTQSPASLSASVGETVTITCRTSENIYSYLAWYQQKQGKSPQLLVYNAKTLAKGVPSRFSGSGSGTQFSLKINGLQPEDFGNYYCQHHYGTPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 236 - DNA, 1692 bp, Artificial Sequence
  Made in lab - synthesized LP1-7I20 Heavy chain IgG2, RSPO2 (F105R/F109A) polynucleotide sequence
gaggtgaagctggtggagtctggaggaggcttggtacagcctgggggttctctgagtctctcctgtgcagcttctggattcaccttcactgattactacatgagctgggtccgccagcccccagggaaggcacttgagtggttggctttgattagaaacaaagctaatggttacacaacagagtacagtgcatctgtgaagggtcggttcaccatctccagggataattcccaaagcatcctctatcttcaaatgaatgccctgagagctgaggacagtgccacttattactgtgcagttacctacggggcttactggggccaagggactctggtcactgtctctgcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 237 - protein, 564 aa, Artificial Sequence
  Made in lab - synthesized LP1-7I20 Heavy chain IgG2, RSPO2 (F105R/F109A) polypeptide sequence
EVKLVESGGGLVQPGGSLSLSCAASGFTFTDYYMSWVRQPPGKALEWLALIRNKANGYTTEYSASVKGRFTISRDNSQSILYLQMNALRAEDSATYYCAVTYGAYWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 238 - DNA, 693 bp, Artificial Sequence
  Made in lab - synthesized LP1-8M24 light chain polynucleotide sequence
gaggttcagctgcagcagtctggggctgagcttgtgaggccaggggcctcagtcaagttgtcctgcacagcttctggctttaccattaaagacgactatattcactgggtgaagcaggggcctgaacagggcctggagtggattggaagaattgatcctgcggatgatgatactaaatatgccccgaagttccaggacaaggccactataactgcagacacatcctccaacacagcctacctgcagctcagcagcctgacatctgaggacactgccgtctattactgtgctagaagttccatggcctggtttgcttactgggcccaagggactctggtcactgtctctacagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtggatccggctccggacatcatcatcaccatcac

SEQ ID NO: 239 - protein, 231 aa, Artificial Sequence
  Made in lab - synthesizedLP1-8M24 light chain polypeptide sequence
EVQLQQSGAELVRPGASVKLSCTASGFTIKDDYIHWVKQGPEQGLEWIGRIDPADDDTKYAPKFQDKATITADTSSNTAYLQLSSLTSEDTAVYYCARSSMAWFAYWAQGTLVTVSTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSGSGHHHHHH

SEQ ID NO: 240 - DNA, 642 bp, Artificial Sequence
  Made in lab - synthesized LP1-8M24 Heavy chain IgG2, RSPO2 (F105R/F109A) polynucleotide sequence
gacatccagatgacacagagccctagcagcctgtctgccagcgtgggagacagagtgaccatcacctgtcggatcagcgagaacatctacagcaacctggcctggtatcagcagaagcctggcaaggcccctaagctgctgatctacgccgccatcaatctggccgatggcgtgccaagcagattttctggcagcggctctggcaccgacttcaccctgaccatatctagcctgcagcctgaggacttcgccacctactactgccagcacttttggggcacccctttcacctttggccagggcaccaagctggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 241 - protein, 214 aa, Artificial Sequence
  Made in lab - synthesized LP1-8M24 Heavy chain IgG2, RSPO2 (F105R/F109A) polypeptide sequence
DIQMTQSPSSLSASVGDRVTITCRISENIYSNLAWYQQKPGKAPKLLIYAAINLADGVPSRFSGSGSGTDFTLTISSLQPEDFATYYCQHFWGTPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 242 - DNA, 657 bp, Artificial Sequence
  Made in lab - synthesized LP1-9C3 light chain polynucleotide sequence
gatgttgtggtgactcaaactccactctccctgcctgtcagctttggagatcaagtttctatctcttgcaggtctagtcagagtcttgcaaacagttatgggaacacctatttgtcttggtacctgcacaagcctggccagtctccacagctcctcatctatgggatttccaacagattttctggggtgccagacaggttcagtggcagtggttcagggacagatttcacactcaagatcagcacaataaagcctgaggacttgggaatctattactgcttacaagctacacatcagccgtggacgttcggtggaggcaccaagctggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 243 - protein, 219 aa, Artificial Sequence
  Made in lab - synthesized LP1-9C3 light chain polypeptide sequence
DVVVTQTPLSLPVSFGDQVSISCRSSQSLANSYGNTYLSWYLHKPGQSPQLLIYGISNRFSGVPDRFSGSGSGTDFTLKISTIKPEDLGIYYCLQATHQPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 244 - DNA, 1695 bp, Artificial Sequence
  Made in lab - synthesized LP1-9C3 Heavy chain IgG2, RSPO2 (F105R/F109A) polynucleotide sequence
caggttactctgaaagagtctggccctgggatattgcagccctcccagaccctcagtctgacttgttctttctctgggttttcactgagcacttcttatatgggtgtgagctggattcgtaagccttcaggaaagggtctggagtggctggcacacattttctgggatgatgacaagcgctataacccatccctgaagagccggctcacaatctccaaggatacctccagcaaccaggtattcctcatgatcaccagtgtggaaactgcagatactgccacatactactgtgggggtccctactatccgtttacttactggggccaagggactctggtcactgtctctgcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 245 - protein, 565 aa, Artificial Sequence
  Made in lab - synthesized LP1-9C3 Heavy chain IgG2, RSPO2 (F105R/F109A) polypeptide sequence
QVTLKESGPGILQPSQTLSLTCSFSGFSLSTSYMGVSWIRKPSGKGLEWLAHIFWDDDKRYNPSLKSRLTISKDTSSNQVFLMITSVETADTATYYCGGPYYPFTYWGQGTLVTVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 246 - DNA, 642 bp, Artificial Sequence
  Made in lab - synthesized LP1-9M16 light chain polynucleotide sequence
gacatcaagatgacccagtctccatcttccatgtatgcatctctaggagagagagtcactatcacttgcaaggcgagtcaggacattaatagctatttaagctggttccagcagaaaccagggaaatctcctaagaccctgatctatcgtgcaaacagattggcagatggggtcccatcaaggttcagtggcagtggatctgggcaagattattctctcaccatcagcaacctggagtatgaagatatgggaatttattattgtctacagtatgatgagtttccgctcacgttcggtgctgggaccaagctggagctgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 247 - protein, 214 aa, Artificial Sequence
  Made in lab - synthesized LP1-9M16 light chain polypeptide sequence
DIKMTQSPSSMYASLGERVTITCKASQDINSYLSWFQQKPGKSPKTLIYRANRLADGVPSRFSGSGSGQDYSLTISNLEYEDMGIYYCLQYDEFPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 248 - DNA, 1686 bp, Artificial Sequence
  Made in lab - synthesized LP1-9M16 Heavy chain IgG2, RSPO2 (F105R/F109A) polynucleotide sequence
gaggtccagctgcaacagtctggacctgagctggtgaagcctggggcttcagtgaagatgtcctgtaaggcttctggatacacattcactgactactacatgaactgggtgaagcagagtcatggaaagagccttgagtggattggacgtgttaatcctaacaatggtggttctaactacaaccagaaattcaagggcaaggccacattgacagtagacaaatccctcagcacagcctacatgcagctcaacagcctgacatctgaggactctgcggtctattactgtgcaagtcgaaacttcgatgtctggggcgcagggaccacggtcaccgtctccagcgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 249 - protein, 562 aa, Artificial Sequence
  Made in lab - synthesized LP1-9M16 Heavy chain IgG2, RSPO2 (F105R/F109A) polypeptide sequence
EVQLQQSGPELVKPGASVKMSCKASGYTFTDYYMNWVKQSHGKSLEWIGRVNPNNGGSNYNQKFKGKATLTVDKSLSTAYMQLNSLTSEDSAVYYCASRNFDVWGAGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 250 - DNA, 657 bp, Artificial Sequence
  Made in lab - synthesized LP1-10C22 light chain polynucleotide sequence
gatgttttgatgacccaaactccactctccctgcctgtcagtcttggagatcaagcctccatctcttgcagatctagtcagggcattgtacatagtaatggaaacatctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctcccacgttcggaggggggaccaagctggaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 251 - protein, 219 aa, Artificial Sequence
  Made in lab - synthesized LP1-10C22 light chain polypeptide sequence
DVLMTQTPLSLPVSLGDQASISCRSSQGIVHSNGNIYLEWYLQKPGQSPKLLIYKVSNRFSGVPDRFSGSGSGTDFTLKISRVEAEDLGVYYCFQGSHVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 252 - DNA, 1704 bp, Artificial Sequence
  Made in lab - synthesized LP1-10C22 Heavy chain IgG2, RSPO2 (F105R/F109A) polynucleotide sequence
gaggtgcagctggtggagtctgggggagacttagtgaagcctggagggtccctgaaactctcctgtgcagcctctggattcactttcagtagttatggcatgtcttgggttcgccagactccagacaagaggctggagtgggtcgcaagtattagtagtggtggtagttatacctactatccagacagtgtgaaggggcgattcaccatctccagagacaatgcccagaacaccctgtacctgcaaatgagcagtctgaagtctgaggacacagccatgtattactgtgtaagacatgaggagtatggtaaatccggatttgcttactggggccaagggaccctgattactgtctctgcagctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggtggtggctcgggatccggaggctccggtggcggtggcagcaacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggag

SEQ ID NO: 253 - protein, 568 aa, Artificial Sequence
  Made in lab - synthesized LP1-10C22 Heavy chain IgG2, RSPO2 (F105R/F109A) polypeptide sequence
EVQLVESGGDLVKPGGSLKLSCAASGFTFSSYGMSWVRQTPDKRLEWVASISSGGSYTYYPDSVKGRFTISRDNAQNTLYLQMSSLKSEDTAMYYCVRHEEYGKSGFAYWGQGTLITVSAASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKGGGGSGSGGSGGGGSNPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVE

SEQ ID NO: 254 - DNA, 1695 bp, Artificial Sequence
  Made in lab - synthesized RSPO2 (F105R/F109A), LP1-1N15 Heavy chain IgG1 N297G polynucleotide sequence
aacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggtggtggtggctcgggatccggaggctccggtggcggtggcagcgaggtccagctgcaacagtctggacctgagctggtgaagcctggggcttcagtgaagatgtcctgtaaggcttctggatacacattcactgactactacatgaactgggtgaagcagagtcatggagagagccttgagtggattggacgtgttattcctagcaatggtggtactaactacaaccagaagttcaagggcaaggccacattgacagtagacaaatccctcaccacagcctacatgcagctcaacagcctgacatctgaagactctgcggtctatttctgtgcaagagggatggactactggggtccaggaacctcagtcaccgtctccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 255 - protein, 565 aa, Artificial Sequence
  Made in lab - synthesized RSPO2 (F105R/F109A), LP1-1N15 Heavy chain IgG1 N297G polypeptide sequence
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGSGGSGGGGSEVQLQQSGPELVKPGASVKMSCKASGYTFTDYYMNWVKQSHGESLEWIGRVIPSNGGTNYNQKFKGKATLTVDKSLTTAYMQLNSLTSEDSAVYFCARGMDYWGPGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - DNA, 1719 bp, Artificial Sequence
  Made in lab - synthesized RSPO2 (F105R/F109A), LP1-1P13 Heavy chain IgG1 N297G polynucleotide sequence
aacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggtggtggtggctcgggatccggaggctccggtggcggtggcagcgaggttcaactgcagcagtctggacctgaactggtgaagcctggggcttcagtgaagatatcctgcaaggcttctggttactcatttactgactactttatgaactgggtgaagcagagccatggaaagagccttgagtggattggacgttttaatcctttcaatggtcaaactttctacaatcaggagttcaagggcaaggccacattaactgtagacaaatcctctagcaccgcccacatggagctccggagcctgacatctgaggactctgcagtctattattgtgcaagaagaggaaggtacgacgtttactatgttctggactactggggtcaaggaacctcagtcaccgtctccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 257 - protein, 573 aa, Artificial Sequence
  Made in lab - synthesized RSPO2 (F105R/F109A), LP1-1P13 Heavy chain IgG1 N297G polypeptide sequence
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGSGGSGGGGSEVQLQQSGPELVKPGASVKISCKASGYSFTDYFMNWVKQSHGKSLEWIGRFNPFNGQTFYNQEFKGKATLTVDKSSSTAHMELRSLTSEDSAVYYCARRGRYDVYYVLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - DNA, 1728 bp, Artificial Sequence
  Made in lab - synthesized RSPO2 (F105R/F109A), LP1-2I22 Heavy chain IgG1 N297G polynucleotide sequence
aacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggtggtggtggctcgggatccggaggctccggtggcggtggcagcgaggtccaactcgtagaatcaggtggtggtttggtcaaaccaggtggctctcggaagttgtcctgtgctgcctctggatttacattcagtgactacggtatgcactgggtccgtcaggctccagagaaggggctggagtgggttgcctacattagtagtggcagtagtaccatctactatgcagacacagtgaagggccgattcaccatctccagagacaatgccaagaacaccctgttcctacaaatgaccagtctaaggtctgaggacacagccatgtattactgttcaaggaagggagggtttggtgactacgagaaaagctatgctatggactactggggtcaaggaacctcagtcaccgtctccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 259 - protein, 576 aa, Artificial Sequence
  Made in lab - synthesized RSPO2 (F105R/F109A), LP1-2I22 Heavy chain IgG1 N297G polypeptide sequence
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGSGGSGGGGSEVQLVESGGGLVKPGGSRKLSCAASGFTFSDYGMHWVRQAPEKGLEWVAYISSGSSTIYYADTVKGRFTISRDNAKNTLFLQMTSLRSEDTAMYYCSRKGGFGDYEKSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 260 - DNA, 1719 bp, Artificial Sequence
  Made in lab - synthesized RSPO2 (F105R/F109A), LP1-2I22 Heavy chain IgG1 N297G polynucleotide sequence
aacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggtggtggtggctcgggatccggaggctccggtggcggtggcagcgaggttcaactgcagcagtctggacctgaactggtgaagcctggggcttcagtgaagatatcctgcaaggcttctggttactcatttactggctactttatgaactgggtgaagcagagccatggaaagagccttgagtggattggacgttttaatcctttcaatggtcaaactttctacaatcaggagttcaagggcaaggccacattaactgttgacaaatcctctgacaccgcccacatggaactccggagcctgacatctgaggactctgcagtctattattgtgcaagaagaggaaggtacgacgtttactatgctctggactactggggtcaaggaacctcagtcaccgtctccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 261 - protein, 573 aa, Artificial Sequence
  Made in lab - synthesized RSPO2 (F105R/F109A), LP1-2I22 Heavy chain IgG1 N297G polypeptide sequence
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGSGGSGGGGSEVQLQQSGPELVKPGASVKISCKASGYSFTGYFMNWVKQSHGKSLEWIGRFNPFNGQTFYNQEFKGKATLTVDKSSDTAHMELRSLTSEDSAVYYCARRGRYDVYYALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - DNA, 1695 bp, Artificial Sequence
  Made in lab - synthesized RSPO2 (F105R/F109A), LP1-3A24 Heavy chain IgG1 N297G polynucleotide sequence
aacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggtggtggtggctcgggatccggaggctccggtggcggtggcagcgaggtccagctgcaacagtctggacctgagctggtgaagcctggggcttcagtgaagatgtcctgtaaggcttctggatacacattcactgactactacataaactgggtgaggcagagtcatggaaagagccttgagtggattggacgtgttattcctagcaatggtggtagtaactacaaccagaagttcaagggcaaggccacattgacagtagacaaatccctcagtacagcctacatgcacctcaacagcctgacatctgaggactctgcggtctattactgtgcaacccagctgggacggtggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 263 - protein, 565 aa, Artificial Sequence
  Made in lab - synthesized RSPO2 (F105R/F109A), LP1-3A24 Heavy chain IgG1 N297G polypeptide sequence
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGSGGSGGGGSEVQLQQSGPELVKPGASVKMSCKASGYTFTDYYINWVRQSHGKSLEWIGRVIPSNGGSNYNQKFKGKATLTVDKSLSTAYMHLNSLTSEDSAVYYCATQLGRWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 264 - DNA, 1719 bp, Artificial Sequence
  Made in lab - synthesized RSPO2 (F105R/F109A), LP1-3E20 Heavy chain IgG1 N297G polynucleotide sequence
aacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggtggtggtggctcgggatccggaggctccggtggcggtggcagccaggtccaactgcagcagtctggggctgaactggcaaaacctggggcctcagtgaagatgtcctgcaaggcttctggctacacctttactagctactggatacactgggtaaaacagaggcctggacagggtctggaatggattggatacattaatcctagcagtggttatgctgagtacaatcagaagttcaaggtcagggccacattgactgcagacaaatcctccagcacagcctacatgcaactaagcagcctgacatctgaggactctgcagtctattactgtgcaagagaaagttactatagtttcgactatactatggactactggggtcaaggaacctcagtcaccgtctccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 265 - protein, 573 aa, Artificial Sequence
  Made in lab - synthesized RSPO2 (F105R/F109A), LP1-3E20 Heavy chain IgG1 N297G polypeptide sequence
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGSGGSGGGGSQVQLQQSGAELAKPGASVKMSCKASGYTFTSYWIHWVKQRPGQGLEWIGYINPSSGYAEYNQKFKVRATLTADKSSSTAYMQLSSLTSEDSAVYYCARESYYSFDYTMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 266 - DNA, 1701 bp, Artificial Sequence
  Made in lab - synthesized RSPO2 (F105R/F109A), LP1-7B13 Heavy chain IgG1 N297G polynucleotide sequence
aacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggtggtggtggctcgggatccggaggctccggtggcggtggcagcgaggtccagctgcaacaatctggacctgaggtggtgaagcctggggcttcagtgaagatgtcctgtaagacttctggattcacattcactgactactacatgaactgggtgaagcagggtcatggaaagagccttgagtggattggacgtgttaatcctagcaatgatgatactaggtacaatcagaagttcaagggaaaggccacattgacagtagacaagtccctcagcacagcctacatgcagctcaacagcctgacatctgaggactctgcggtctattactgtacaaggtggttctactttgactactggggccaaggcactactctcacagtctccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 267 - protein, 567 aa, Artificial Sequence
  Made in lab - synthesized RSPO2 (F105R/F109A), LP1-7B13 Heavy chain IgG1 N297G polypeptide sequence
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGSGGSGGGGSEVQLQQSGPEVVKPGASVKMSCKTSGFTFTDYYMNWVKQGHGKSLEWIGRVNPSNDDTRYNQKFKGKATLTVDKSLSTAYMQLNSLTSEDSAVYYCTRWFYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 268 - DNA, 708 bp, Artificial Sequence
  Made in lab - synthesized RSPO2 (F105R/F109A), LP1-8M24 Heavy chain IgG1 N297G polynucleotide sequence
caggttcagctgcagcagtctggagctgagctggcgaggcctggggcttcagtgaagctgtcctgcaaggcttctggctacaccttcacaaattatggtataaactgggtgaagcagagaactggacagggccttgagtggattggagagatttttcctagaagtgataatactttctacaatgagaagttcaagggcaaggccacactgactgcagacaaatcctccaccacagcgtacatggagctccgcagcctgacatctgaggactctgcggtctatttctgtgcaagaaaaggcagggactacggtactagccactactttgactactggggtcaaggcaccactctcacagtctccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtggatccggctccggacatcatcatcaccatcac

SEQ ID NO: 269 - protein, 236 aa, Artificial Sequence
  Made in lab - synthesizedRSPO2 (F105R/F109A), LP1-8M24 Heavy chain IgG1 N297G polypeptide sequence
QVQLQQSGAELARPGASVKLSCKASGYTFTNYGINWVKQRTGQGLEWIGEIFPRSDNTFYNEKFKGKATLTADKSSTTAYMELRSLTSEDSAVYFCARKGRDYGTSHYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSGSGHHHHHH

SEQ ID NO: 270 - DNA, 1698 bp, Artificial Sequence
  Made in lab - synthesized RSPO2 (F105R/F109A), LP1-9M16 Heavy chain IgG1 N297G polynucleotide sequence
aacccaatttgcaagggatgcttaagctgtagcaaggacaacggatgttcacggtgccagcaaaagctgtttttcttcctccggcgggaaggaatgcggcagtacggcgaatgtctccactcctgcccctcggggtattacggacaccgcgcgcctgacatgaaccgatgcgccagatgccggatcgagaactgcgatagctgccgcagcaaggacgcctgcactaagtgcaaagtcggcttctaccttcaccggggcagatgttttgacgaatgcccggatggcttcgccccgctggaggagactatggaatgcgtggagggtggtggtggctcgggatccggaggctccggtggcggtggcagcgaggtccagctgcaacagtctggacctgagctggtgaagcctggggcttcagtgaagatgtcctgtaaggcttctggatacacattcactgactactacatgaactgggtgaagcagagtcatggaaagagccttgagtggattggacgtgttaatcctaacaatggtggttctaactacaaccagaaattcaagggcaaggccacattgacagtagacaaatccctcagcacagcctacatgcagctcaacagcctgacatctgaggactctgcggtctattactgtgcaagtcgaaacttcgatgtctggggcgcagggaccacggtcaccgtctccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 271 - protein, 566 aa, Artificial Sequence
  Made in lab - synthesized RSPO2 (F105R/F109A), LP1-9M16 Heavy chain IgG1 N297G polypeptide sequence
NPICKGCLSCSKDNGCSRCQQKLFFFLRREGMRQYGECLHSCPSGYYGHRAPDMNRCARCRIENCDSCRSKDACTKCKVGFYLHRGRCFDECPDGFAPLEETMECVEGGGGSGSGGSGGGGSEVQLQQSGPELVKPGASVKMSCKASGYTFTDYYMNWVKQSHGKSLEWIGRVNPNNGGSNYNQKFKGKATLTVDKSLSTAYMQLNSLTSEDSAVYYCASRNFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 272 - DNA, 1338 bp, Artificial Sequence
  Made in lab - synthesized Anti-ASGR1 heavy chain polynucleotide sequence
gaagtgcagctgctggaatccgggggcggactggtgcaacccgggggatccctcagactgtcctgtgccgcatcgggtttcactttctcctcctacgcgatgtcatgggtcagacaggcccctggaaaaggcctcgaatgggtgtcggctatctccggatcggggggatctacttactacgccgactccgtgaagggccggttcactatctcgagggacaactccaagaataccctgtacttgcaaatgaactccctgcgcgccgaggataccgcggtgtattactgcgccaaggacttcagctcacgccggtggtaccttgagtactggggacagggaacccttgtcaccgtgtcgagtgctagcaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacgcctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 273 - protein, 446 aa, Artificial Sequence
  Made in lab - synthesized Anti-ASGR1 heavy chain polypeptide sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDFSSRRWYLEYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 274 - protein, 112 aa, Artificial Sequence
  Made in Lab - synthesized LP1-1F8 VL polypeptide sequence
DIVMSQSPSSLAVSAGEKVTMSCKSSQSLFNSRTRKNYLAWYQQKPGQSPKLLIYWASTRESGVPDRFTGSGSGTDFTLTISSVQAEDLAVYYCKQSYYLLTFGAGTKLELK

SEQ ID NO: 275 - protein, 121 aa, Artificial Sequence
  Made in Lab - synthesized LP1-1F8 VH polypeptide sequence
EVKLVESGGGLVKPGGSLKLSCAASGFTFSTYTMSWVRQTPAKRLEWVATISSIGVNTYYPDSVKGRFTISRDNARNTLYLQVSSLRSEDTAMYYCARHVDYYDGISFDYWGQGTTLTVSS

SEQ ID NO: 276 - protein, 107 aa, Artificial Sequence
  Made in Lab - synthesized LP1-1N15 VL polypeptide sequence
DIKMTQSPSSMYASLGERVTITCKASQDINSHLSWFQQKPGKSPKTLIIRANRLVDGVPSRFSGSGSGQDYSLTISSPEYEEMGIYYCLQYDEFPFTFGGGTKLEIK

SEQ ID NO: 277 - protein, 113 aa, Artificial Sequence
  Made in Lab - synthesized LP1-1N15 VH polypeptide sequence
EVQLQQSGPELVKPGASVKMSCKASGYTFTDYYMNWVKQSHGESLEWIGRVIPSNGGTNYNQKFKGKATLTVDKSLTTAYMQLNSLTSEDSAVYFCARGMDYWGPGTSVTVSS

SEQ ID NO: 278 - protein, 107 aa, Artificial Sequence; identical to SEQ ID NO: 199
  Made in Lab - synthesized LP1-1P13 VL polypeptide sequence

SEQ ID NO: 279 - protein, 121 aa, Artificial Sequence
  Made in Lab - synthesized LP1-1P13 VH polypeptide sequence
EVQLQQSGPELVKPGASVKISCKASGYSFTDYFMNWVKQSHGKSLEWIGRFNPFNGQTFYNQEFKGKATLTVDKSSSTAHMELRSLTSEDSAVYYCARRGRYDVYYVLDYWGQGTSVTVSS

SEQ ID NO: 280 - protein, 107 aa, Artificial Sequence
  Made in Lab - synthesized LP1-1P5 VL polypeptide sequence
DIVMTQSQKFMSTSVGDRVSVTCKASQNVGTNVAWYQQKPGQSPKALIYSASYRYSGVPDRFTGSGSGTDFTLTISNVQSEDLAEYFCQQYNSYPLTFGAGTKLELK

SEQ ID NO: 281 - protein, 120 aa, Artificial Sequence
  Made in Lab - synthesized LP1-1P5 VH polypeptide sequence
QVQLQQSGPELVRPGTSVKISCKASGYTFLTYWMNWVKQRPGQGLEWIGQIFPATGITYYSEMFKDKATLTEDTSSTTAYMQLSSLTSEATAVYFCARRRAYHSNFFDYWGQGTTLTVSS

SEQ ID NO: 282 - protein, 112 aa, Artificial Sequence
  Made in Lab - synthesized LP1-2E12 VL polypeptide sequence
DVVVTQTPLSLPVSFGDRVSISCRSSQSLANSYGNTYLSWYLHKPGQSPQLLIYGISNRFSGVPDRFSGSGSGTDFTLKISTIKPEDLGMYYCLQGTHQPLTFGAGTKLELK

SEQ ID NO: 283 - protein, 115 aa, Artificial Sequence
  Made in Lab - synthesized LP1-2E12 VH polypeptide sequence
DVQLQESGPGLVKPSQSLSLTCSVTGYSITSGYYWNWIRQFPGNKLEWMGSIGYDDTNHYNPSLKNRISITRDTSKNQFFLKLNSVTTEDTATYYCAGDYPFAFWGQGTLVTVSA

SEQ ID NO: 284 - protein, 106 aa, Artificial Sequence
  Made in Lab - synthesized LP1-2I13 VL polypeptide sequence
DIQMTQSPASLSASVGETVTITCRASENIYSYLVWYQQKQGKSPQLLVYNAKTLAEGVPSRFSGSGSGTQFSLKINSLQPEDFGSYYCQHHYGTWTFGGGIKLEIK

SEQ ID NO: 285 - protein, 124 aa, Artificial Sequence
  Made in Lab - synthesized LP1-2I13 VH polypeptide sequence
EVQLVESGGGLVKPGGSRKLSCAASGFTFSDYGMHWVRQAPEKGLEWVAYISSGSSTIYYADTVKGRFTISRDNAKNTLFLQMTSLRSEDTAMYYCSRKGGFGDYEKSYAMDYWGQGTSVTVSS

SEQ ID NO: 286 - protein, 107 aa, Artificial Sequence
  Made in Lab - synthesized LP1-2I22 VL polypeptide sequence
DIQMTQSPASLSASVGETVIITCRASENIYSNLAWYQQKQGKSPQLLVYGATNLADGVTSRFSGSGSGTQFSLKIDSLQSEDFGSYYCQHFWGTTWTFGGGTKLEIK

SEQ ID NO: 287 - protein, 121 aa, Artificial Sequence
  Made in Lab - synthesized LP1-2I22 VH polypeptide sequence
EVQLQQSGPELVKPGASVKISCKASGYSFTGYFMNWVKQSHGKSLEWIGRFNPFNGQTFYNQEFKGKATLTVDKSSDTAHMELRSLTSEDSAVYYCARRGRYDVYYALDYWGQGTSVTVSS

SEQ ID NO: 288 - protein, 107 aa, Artificial Sequence
  Made in Lab - synthesized LP1-3A24 VL polypeptide sequence
DIVMTQSQKFMSTSVGDRVSVTCKASQNVGSNVAWFQQKPGQSPKALIYSSSYRYSGVPDRFTGSGSGTDFTLTITNVQSEDLAEYFCQQYNSFPLTFGAGTKLELK

SEQ ID NO: 289 - protein, 113 aa, Artificial Sequence
  Made in Lab - synthesized LP1-3A24 VH polypeptide sequence
EVQLQQSGPELVKPGASVKMSCKASGYTFTDYYINWVRQSHGKSLEWIGRVIPSNGGSNYNQKFKGKATLTVDKSLSTAYMHLNSLTSEDSAVYYCATQLGRWGQGTLVTVSA

SEQ ID NO: 290 - protein, 106 aa, Artificial Sequence
  Made in Lab - synthesized LP1-3E20 VL polypeptide sequence
DIKMTQSPSSMYASLGERVTITCKASQDINSYLSWFQQKPGKSPKTLIYRANRLVDGVPSRFSGSGSGQDYSLTISSLEYEDMGIYYCLQYDDLWTFGGGTKLEIK

SEQ ID NO: 291 - protein, 121 aa, Artificial Sequence
  Made in Lab - synthesized LP1-3E20 VH polypeptide sequence
QVQLQQSGAELAKPGASVKMSCKASGYTFTSYWIHWVKQRPGQGLEWIGYINPSSGYAEYNQKFKVRATLTADKSSSTAYMQLSSLTSEDSAVYYCARESYYSFDYTMDYWGQGTSVTVSS

SEQ ID NO: 292 - protein, 112 aa, Artificial Sequence
  Made in Lab - synthesized LP1-6H3 VL polypeptide sequence
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPHTFGSGTKLEIK

SEQ ID NO: 293 - protein, 115 aa, Artificial Sequence
  Made in Lab - synthesized LP1-6H3 VH polypeptide sequence
QAYLQQSGAELVRPGASVKMSCKASGYTFSRFDMHWVKQTPRQGLEWIGVIYPGNGDTSYNQKFRDKASLTVDKSSSTAYMQLSSLTSEDSAVYFCASSYYGNPWGQGTTLTVSS

SEQ ID NO: 294 - protein, 107 aa, Artificial Sequence
  Made in Lab - synthesized LP1-7B13 VL polypeptide sequence
DIVLTQSPATLSVTPGDRVSLSCRASQSISNYLHWYQQKSHESPRLLIKFASQSISGIPSRFSGSGSGTDFTLTINSVETEDFGMYFCQQSNSWPLTFGAGTKLELK

SEQ ID NO: 295 - protein, 115 aa, Artificial Sequence
  Made in Lab - synthesized LP1-7B13 VH polypeptide sequence
EVQLQQSGPEVVKPGASVKMSCKTSGFTFTDYYMNWVKQGHGKSLEWIGRVNPSNDDTRYNQKFKGKATLTVDKSLSTAYMQLNSLTSEDSAVYYCTRWFYFDYWGQGTTLTVSS

SEQ ID NO: 296 - protein, 107 aa, Artificial Sequence
  Made in Lab - synthesized LP1-7I20 VL polypeptide sequence
DIQMTQSPASLSASVGETVTITCRTSENIYSYLAWYQQKQGKSPQLLVYNAKTLAKGVPSRFSGSGSGTQFSLKINGLQPEDFGNYYCQHHYGTPYTFGGGTKVEIK

SEQ ID NO: 297 - protein, 116 aa, Artificial Sequence
  Made in Lab - synthesized LP1-7I20 VH polypeptide sequence
EVKLVESGGGLVQPGGSLSLSCAASGFTFTDYYMSWVRQPPGKALEWLALIRNKANGYTTEYSASVKGRFTISRDNSQSILYLQMNALRAEDSATYYCAVTYGAYWGQGTLVTVSA

SEQ ID NO: 298 - protein, 107 aa, Artificial Sequence
  Made in Lab - synthesized LP1-8M24 VL polypeptide sequence
DIQMTQSPASLSVSVGETVTITCRISENIYSNLAWYQQKQGKSPHLLVYAAINLADGVPSRFSGSGSGTQFSLKINSLQSEDFGSYYCQHFWGTPFTFGSGTKLEIK

SEQ ID NO: 299 - protein, 122 aa, Artificial Sequence
  Made in Lab - synthesized LP1-7I20 VH polypeptide sequence
QVQLQQSGAELARPGASVKLSCKASGYTFTNYGINWVKQRTGQGLEWIGEIFPRSDNTFYNEKFKGKATLTADKSSTTAYMELRSLTSEDSAVYFCARKGRDYGTSHYFDYWGQGTTLTVSS

SEQ ID NO: 300 - protein, 112 aa, Artificial Sequence
  Made in Lab - synthesized LP1-9C3 VL polypeptide sequence
DVVVTQTPLSLPVSFGDQVSISCRSSQSLANSYGNTYLSWYLHKPGQSPQLLIYGISNRFSGVPDRFSGSGSGTDFTLKISTIKPEDLGIYYCLQATHQPWTFGGGTKLEIK

SEQ ID NO: 301 - protein, 117 aa, Artificial Sequence
  Made in Lab - synthesized LP1-9C3 VH polypeptide sequence
QVTLKESGPGILQPSQTLSLTCSFSGFSLSTSYMGVSWIRKPSGKGLEWLAHIFWDDDKRYNPSLKSRLTISKDTSSNQVFLMITSVETADTATYYCGGPYYPFTYWGQGTLVTVSA

SEQ ID NO: 302 - protein, 107 aa, Artificial Sequence
  Made in Lab - synthesized LP1-9M16 VL polypeptide sequence
DIKMTQSPSSMYASLGERVTITCKASQDINSYLSWFQQKPGKSPKTLIYRANRLADGVPSRFSGSGSGQDYSLTISNLEYEDMGIYYCLQYDEFPLTFGAGTKLELK

SEQ ID NO: 303 - protein, 114 aa, Artificial Sequence
  Made in Lab - synthesized LP1-9M16 VH polypeptide sequence
EVQLQQSGPELVKPGASVKMSCKASGYTFTDYYMNWVKQSHGKSLEWIGRVNPNNGGSNYNQKFKGKATLTVDKSLSTAYMQLNSLTSEDSAVYYCASRNFDVWGAGTTVTVSS

SEQ ID NO: 304 - protein, 112 aa, Artificial Sequence
  Made in Lab - synthesized LP1-10C22 VL polypeptide sequence
DVLMTQTPLSLPVSLGDQASISCRSSQGIVHSNGNIYLEWYLQKPGQSPKLLIYKVSNRFSGVPDRFSGSGSGTDFTLKISRVEAEDLGVYYCFQGSHVPPTFGGGTKLEIK

SEQ ID NO: 305 - protein, 120 aa, Artificial Sequence
  Made in Lab - synthesized LP1-10C22 VH polypeptide sequence
EVQLVESGGDLVKPGGSLKLSCAASGFTFSSYGMSWVRQTPDKRLEWVASISSGGSYTYYPDSVKGRFTISRDNAQNTLYLQMSSLKSEDTAMYYCVRHEEYGKSGFAYWGQGTLITVSA

SEQ ID NO: 306 - protein, 11 aa, Artificial Sequence
  Made in Lab - synthesized CDRH1 sequence of binders against hRNF43/ZNRF3
DSVSSNSAAWY

SEQ ID NO: 307 - protein, 9 aa, Artificial Sequence
  Made in Lab - synthesized CDRH1 sequence of binders against hRNF43/ZNRF3
DTFTGYYIH

SEQ ID NO: 308 - protein, 9 aa, Artificial Sequence
  Made in Lab - synthesized CDRH1 sequence of binders against hRNF43/ZNRF3
FAFSNFAMI

SEQ ID NO: 309 - protein, 9 aa, Artificial Sequence
  Made in Lab - synthesized CDRH1 sequence of binders against hRNF43/ZNRF3
FSFSNYAMS

SEQ ID NO: 310 - protein, 9 aa, Artificial Sequence
  Made in Lab - synthesized CDRH1 sequence of binders against hRNF43/ZNRF3
FTFNNFGMS

SEQ ID NO: 311 - protein, 9 aa, Artificial Sequence
  Made in Lab - synthesized CDRH1 sequence of binders against hRNF43/ZNRF3
FTFSNYAMG

SEQ ID NO: 312 - protein, 9 aa, Artificial Sequence
  Made in Lab - synthesized CDRH1 sequence of binders against hRNF43/ZNRF3
FTFSSYAMH

SEQ ID NO: 313 - protein, 7 aa, Artificial Sequence
  Made in Lab - synthesized CDRH1 sequence of binders against hRNF43/ZNRF3
GFNIKDD

SEQ ID NO: 314 - protein, 7 aa, Artificial Sequence
  Made in Lab - synthesized CDRH1 sequence of binders against hRNF43/ZNRF3
GFNIKDT

SEQ ID NO: 315 - protein, 7 aa, Artificial Sequence
  Made in Lab - synthesized CDRH1 sequence of binders against hRNF43/ZNRF3
GFTFSDY

SEQ ID NO: 316 - protein, 9 aa, Artificial Sequence
  Made in Lab - synthesized CDRH1 sequence of binders against hRNF43/ZNRF3
GTFSGYYMH

SEQ ID NO: 317 - protein, 9 aa, Artificial Sequence
  Made in Lab - synthesized CDRH1 sequence of binders against hRNF43/ZNRF3
GTFSNTDIN

SEQ ID NO: 318 - protein, 9 aa, Artificial Sequence
  Made in Lab - synthesized CDRH1 sequence of binders against hRNF43/ZNRF3
GTFSNYAIS

SEQ ID NO: 319 - protein, 9 aa, Artificial Sequence
  Made in Lab - synthesized CDRH1 sequence of binders against hRNF43/ZNRF3
GTFSNYSLS

SEQ ID NO: 320 - protein, 9 aa, Artificial Sequence
  Made in Lab - synthesized CDRH1 sequence of binders against hRNF43/ZNRF3
GTFSSYAIS

SEQ ID NO: 321 - protein, 9 aa, Artificial Sequence
  Made in Lab - synthesized CDRH1 sequence of binders against hRNF43/ZNRF3
GTFSTSGIT

SEQ ID NO: 322 - protein, 9 aa, Artificial Sequence
  Made in Lab - synthesized CDRH1 sequence of binders against hRNF43/ZNRF3
YRFTNYYMH

SEQ ID NO: 323 - protein, 9 aa, Artificial Sequence
  Made in Lab - synthesized CDRH1 sequence of binders against hRNF43/ZNRF3
YRFTSYYLH

SEQ ID NO: 324 - protein, 9 aa, Artificial Sequence
  Made in Lab - synthesized CDRH1 sequence of binders against hRNF43/ZNRF3
YTFIGYYMH

SEQ ID NO: 325 - protein, 9 aa, Artificial Sequence
  Made in Lab - synthesized CDRH1 sequence of binders against hRNF43/ZNRF3
YTFRRYPMH

SEQ ID NO: 326 - protein, 9 aa, Artificial Sequence
  Made in Lab - synthesized CDRH1 sequence of binders against hRNF43/ZNRF3
YTFSRYFMH

SEQ ID NO: 327 - protein, 9 aa, Artificial Sequence
  Made in Lab - synthesized CDRH1 sequence of binders against hRNF43/ZNRF3
YTFTAYYMH

SEQ ID NO: 328 - protein, 9 aa, Artificial Sequence
  Made in Lab - synthesized CDRH1 sequence of binders against hRNF43/ZNRF3
YTFTEYYMH

SEQ ID NO: 329 - protein, 9 aa, Artificial Sequence
  Made in Lab - synthesized CDRH1 sequence of binders against hRNF43/ZNRF3
YTFTGYYMH

SEQ ID NO: 330 - protein, 9 aa, Artificial Sequence
  Made in Lab - synthesized CDRH1 sequence of binders against hRNF43/ZNRF3
YTFTNYGIS

SEQ ID NO: 331 - protein, 9 aa, Artificial Sequence
  Made in Lab - synthesized CDRH1 sequence of binders against hRNF43/ZNRF3
YTFTNYKMH

SEQ ID NO: 332 - protein, 9 aa, Artificial Sequence
  Made in Lab - synthesized CDRH1 sequence of binders against hRNF43/ZNRF3
YTFTNYYMH

SEQ ID NO: 333 - protein, 9 aa, Artificial Sequence
  Made in Lab - synthesized CDRH1 sequence of binders against hRNF43/ZNRF3
YTFTRHYMH

SEQ ID NO: 334 - protein, 9 aa, Artificial Sequence
  Made in Lab - synthesized CDRH1 sequence of binders against hRNF43/ZNRF3
YTFTRYYMH

SEQ ID NO: 335 - protein, 9 aa, Artificial Sequence
  Made in Lab - synthesized CDRH1 sequence of binders against hRNF43/ZNRF3
YTFTSYAMH

SEQ ID NO: 336 - protein, 9 aa, Artificial Sequence
  Made in Lab - synthesized CDRH1 sequence of binders against hRNF43/ZNRF3
YTFTSYDIN

SEQ ID NO: 337 - protein, 9 aa, Artificial Sequence
  Made in Lab - synthesized CDRH1 sequence of binders against hRNF43/ZNRF3
YTFTSYGVS

SEQ ID NO: 338 - protein, 9 aa, Artificial Sequence
  Made in Lab - synthesized CDRH1 sequence of binders against hRNF43/ZNRF3
YTFTSYYLH

SEQ ID NO: 339 - protein, 9 aa, Artificial Sequence
  Made in Lab - synthesized CDRH1 sequence of binders against hRNF43/ZNRF3
YTFTSYYMH

SEQ ID NO: 340 - protein, 6 aa, Artificial Sequence
  Made in Lab - synthesized CDRH2 sequence of binders against hRNF43/ZNRF3
DPANGK

SEQ ID NO: 341 - protein, 6 aa, Artificial Sequence
  Made in Lab - synthesized CDRH2 sequence of binders against hRNF43/ZNRF3
DPENGD

SEQ ID NO: 342 - protein, 13 aa, Artificial Sequence
  Made in Lab - synthesized CDRH2 sequence of binders against hRNF43/ZNRF3
GGIIPIFDAATYA

SEQ ID NO: 343 - protein, 13 aa, Artificial Sequence
  Made in Lab - synthesized CDRH2 sequence of binders against hRNF43/ZNRF3
GGIIPIFDATNYA

SEQ ID NO: 344 - protein, 13 aa, Artificial Sequence
  Made in Lab - synthesized CDRH2 sequence of binders against hRNF43/ZNRF3
GGIIPIFGTANYA

SEQ ID NO: 345 - protein, 13 aa, Artificial Sequence
  Made in Lab - synthesized CDRH2 sequence of binders against hRNF43/ZNRF3
GIINPNGGRTTYA

SEQ ID NO: 346 - protein, 13 aa, Artificial Sequence
  Made in Lab - synthesized CDRH2 sequence of binders against hRNF43/ZNRF3
GIINPRGGSTSYA

SEQ ID NO: 347 - protein, 13 aa, Artificial Sequence
  Made in Lab - synthesized CDRH2 sequence of binders against hRNF43/ZNRF3
GIINPRRGSTRYA

SEQ ID NO: 348 - protein, 13 aa, Artificial Sequence
  Made in Lab - synthesized CDRH2 sequence of binders against hRNF43/ZNRF3
GIINPSGGSANYA

SEQ ID NO: 349 - protein, 13 aa, Artificial Sequence
  Made in Lab - synthesized CDRH2 sequence of binders against hRNF43/ZNRF3
GIINPSGGSTSYA

SEQ ID NO: 350 - protein, 13 aa, Artificial Sequence
  Made in Lab - synthesized CDRH2 sequence of binders against hRNF43/ZNRF3
GKINPSSGSTSYA

SEQ ID NO: 351 - protein, 13 aa, Artificial Sequence
  Made in Lab - synthesized CDRH2 sequence of binders against hRNF43/ZNRF3
GRIKPNSGNTGYA

SEQ ID NO: 352 - protein, 13 aa, Artificial Sequence
  Made in Lab - synthesized CDRH2 sequence of binders against hRNF43/ZNRF3
GRISPNRGGTKYA

SEQ ID NO: 353 - protein, 14 aa, Artificial Sequence
  Made in Lab - synthesized CDRH2 sequence of binders against hRNF43/ZNRF3
GRTYYRSKWYHDYA

SEQ ID NO: 354 - protein, 13 aa, Artificial Sequence
  Made in Lab - synthesized CDRH2 sequence of binders against hRNF43/ZNRF3
GVINPGGSDTTYA

SEQ ID NO: 355 - protein, 13 aa, Artificial Sequence
  Made in Lab - synthesized CDRH2 sequence of binders against hRNF43/ZNRF3
GWINAGNGNTKYS

SEQ ID NO: 356 - protein, 13 aa, Artificial Sequence
  Made in Lab - synthesized CDRH2 sequence of binders against hRNF43/ZNRF3
GWINPHSGGTNYA

SEQ ID NO: 357 - protein, 13 aa, Artificial Sequence
  Made in Lab - synthesized CDRH2 sequence of binders against hRNF43/ZNRF3
GWINPNRGGTSYA

SEQ ID NO: 358 - protein, 13 aa, Artificial Sequence
  Made in Lab - synthesized CDRH2 sequence of binders against hRNF43/ZNRF3
GWINPNSGGTNYA

SEQ ID NO: 359 - protein, 13 aa, Artificial Sequence
  Made in Lab - synthesized CDRH2 sequence of binders against hRNF43/ZNRF3
GWINPNSGGTRYA

SEQ ID NO: 360 - protein, 13 aa, Artificial Sequence
  Made in Lab - synthesized CDRH2 sequence of binders against hRNF43/ZNRF3
GWINPNSGNTKYA

SEQ ID NO: 361 - protein, 13 aa, Artificial Sequence
  Made in Lab - synthesized CDRH2 sequence of binders against hRNF43/ZNRF3
GWINPNTGGTKSA

SEQ ID NO: 362 - protein, 13 aa, Artificial Sequence
  Made in Lab - synthesized CDRH2 sequence of binders against hRNF43/ZNRF3
GWISADNGNTNYA

SEQ ID NO: 363 - protein, 13 aa, Artificial Sequence
  Made in Lab - synthesized CDRH2 sequence of binders against hRNF43/ZNRF3
GWISPNSGATNYA

SEQ ID NO: 364 - protein, 13 aa, Artificial Sequence
  Made in Lab - synthesized CDRH2 sequence of binders against hRNF43/ZNRF3
GWMNPKSGGTNYA

SEQ ID NO: 365 - protein, 13 aa, Artificial Sequence
  Made in Lab - synthesized CDRH2 sequence of binders against hRNF43/ZNRF3
GWMNPNSGHAGSA

SEQ ID NO: 366 - protein, 13 aa, Artificial Sequence
  Made in Lab - synthesized CDRH2 sequence of binders against hRNF43/ZNRF3
GWMNPNSGNTGYA

SEQ ID NO: 367 - protein, 13 aa, Artificial Sequence
  Made in Lab - synthesized CDRH2 sequence of binders against hRNF43/ZNRF3
GWMNPNTGGIKYS

SEQ ID NO: 368 - protein, 13 aa, Artificial Sequence
  Made in Lab - synthesized CDRH2 sequence of binders against hRNF43/ZNRF3
GWVNPKNGHTGYA

SEQ ID NO: 369 - protein, 8 aa, Artificial Sequence
  Made in Lab - synthesized CDRH2 sequence of binders against hRNF43/ZNRF3
KSKTDGGI

SEQ ID NO: 370 - protein, 13 aa, Artificial Sequence
  Made in Lab - synthesized CDRH2 sequence of binders against hRNF43/ZNRF3
SAISGSGGSTYYA

SEQ ID NO: 371 - protein, 13 aa, Artificial Sequence
  Made in Lab - synthesized CDRH2 sequence of binders against hRNF43/ZNRF3
SAISGSGRTTYYA

SEQ ID NO: 372 - protein, 11 aa, Artificial Sequence
  Made in Lab - synthesized CDRH2 sequence of binders against hRNF43/ZNRF3
SAISGSGTYYA

SEQ ID NO: 373 - protein, 13 aa, Artificial Sequence
  Made in Lab - synthesized CDRH2 sequence of binders against hRNF43/ZNRF3
SGISASGRNTYYA

SEQ ID NO: 374 - protein, 10 aa, Artificial Sequence
  Made in Lab - synthesized CDRH3 sequence of binders against hRNF43/ZNRF3
AIYYLEAFDV

SEQ ID NO: 375 - protein, 20 aa, Artificial Sequence
  Made in Lab - synthesized CDRH3 sequence of binders against hRNF43/ZNRF3
CAKDLEHTGYSSGWAGFDYW

SEQ ID NO: 376 - protein, 22 aa, Artificial Sequence
  Made in Lab - synthesized CDRH3 sequence of binders against hRNF43/ZNRF3
CAKDSGYCSSTSCYDGGYFDLW

SEQ ID NO: 377 - protein, 14 aa, Artificial Sequence
  Made in Lab - synthesized CDRH3 sequence of binders against hRNF43/ZNRF3
CAKSRALKGSYTSW

SEQ ID NO: 378 - protein, 14 aa, Artificial Sequence
  Made in Lab - synthesized CDRH3 sequence of binders against hRNF43/ZNRF3
CARDGLGVDAFDIW

SEQ ID NO: 379 - protein, 13 aa, Artificial Sequence [sequence omitted]

SEQ ID NO: 380 - protein, 12 aa, Artificial Sequence
  Made in Lab - synthesized CDRH3 sequence of binders against hRNF43/ZNRF3
CARDKVGAIDYW

SEQ ID NO: 381 - protein, 16 aa, Artificial Sequence
  Made in Lab - synthesized CDRH3 sequence of binders against hRNF43/ZNRF3
CARDLMVRGGPPFDYW

SEQ ID NO: 382 - protein, 15 aa, Artificial Sequence
  Made in Lab - synthesized CDRH3 sequence of binders against hRNF43/ZNRF3
CARDPVRGISAFDYW

SEQ ID NO: 383 - protein, 17 aa, Artificial Sequence
  Made in Lab - synthesized CDRH3 sequence of binders against hRNF43/ZNRF3
CARDQGHDYGDYEIDYW

SEQ ID NO: 384 - protein, 18 aa, Artificial Sequence
  Made in Lab - synthesized CDRH3 sequence of binders against hRNF43/ZNRF3
CARDQKGKSSSWFRFDPW

SEQ ID NO: 385 - protein, 14 aa, Artificial Sequence
  Made in Lab - synthesized CDRH3 sequence of binders against hRNF43/ZNRF3
CARDSWLRGAWGYW

SEQ ID NO: 386 - protein, 16 aa, Artificial Sequence
  Made in Lab - synthesized CDRH3 sequence of binders against hRNF43/ZNRF3
CAREDYNWNDGWFDPW

SEQ ID NO: 387 - protein, 12 aa, Artificial Sequence
  Made in Lab - synthesized CDRH3 sequence of binders against hRNF43/ZNRF3
CARETRHGSDYW

SEQ ID NO: 388 - protein, 23 aa, Artificial Sequence
  Made in Lab - synthesized CDRH3 sequence of binders against hRNF43/ZNRF3
CARGDFWSGYYPYYYYYYGMDVW

SEQ ID NO: 389 - protein, 16 aa, Artificial Sequence
  Made in Lab - synthesized CDRH3 sequence of binders against hRNF43/ZNRF3
CARGGRSYGYWYFDLW

SEQ ID NO: 390 - protein, 15 aa, Artificial Sequence
  Made in Lab - synthesized CDRH3 sequence of binders against hRNF43/ZNRF3
CARGGRTTVTTMAYW

SEQ ID NO: 391 - protein, 12 aa, Artificial Sequence
  Made in Lab - synthesized CDRH3 sequence of binders against hRNF43/ZNRF3
CARGGSGWLDYW

SEQ ID NO: 392 - protein, 14 aa, Artificial Sequence
  Made in Lab - synthesized CDRH3 sequence of binders against hRNF43/ZNRF3
CARGMYSSSWLRYW

SEQ ID NO: 393 - protein, 12 aa, Artificial Sequence
  Made in Lab - synthesized CDRH3 sequence of binders against hRNF43/ZNRF3
CARGRQGVWDYW

SEQ ID NO: 394 - protein, 15 aa, Artificial Sequence
  Made in Lab - synthesized CDRH3 sequence of binders against hRNF43/ZNRF3
CARGRRSGLSPPAYW

SEQ ID NO: 395 - protein, 22 aa, Artificial Sequence
  Made in Lab - synthesized CDRH3 sequence of binders against hRNF43/ZNRF3
CARGRRSRGSSSLGYYYYMDVW

SEQ ID NO: 396 - protein, 12 aa, Artificial Sequence
  Made in Lab - synthesized CDRH3 sequence of binders against hRNF43/ZNRF3
CARGRSGNWKFW

SEQ ID NO: 397 - protein, 19 aa, Artificial Sequence
  Made in Lab - synthesized CDRH3 sequence of binders against hRNF43/ZNRF3
CARGRVVRGVIISYGMDVW

SEQ ID NO: 398 - protein, 12 aa, Artificial Sequence
  Made in Lab - synthesized CDRH3 sequence of binders against hRNF43/ZNRF3
CARGSLGYFDLW

SEQ ID NO: 399 - protein, 11 aa, Artificial Sequence
  Made in Lab - synthesized CDRH3 sequence of binders against hRNF43/ZNRF3
CARGSNGMDVW

SEQ ID NO: 400 - protein, 13 aa, Artificial Sequence
  Made in Lab - synthesized CDRH3 sequence of binders against hRNF43/ZNRF3
CARLRANYGMDVW

SEQ ID NO: 401 - protein, 16 aa, Artificial Sequence
  Made in Lab - synthesized CDRH3 sequence of binders against hRNF43/ZNRF3
CARRQYSGYDTHFDYW

SEQ ID NO: 402 - protein, 13 aa, Artificial Sequence
  Made in Lab - synthesized CDRH3 sequence of binders against hRNF43/ZNRF3
CARRRDGYNWGYW

SEQ ID NO: 403 - protein, 11 aa, Artificial Sequence
  Made in Lab - synthesized CDRH3 sequence of binders against hRNF43/ZNRF3
CARRTSSFSLW

SEQ ID NO: 404 - protein, 14 aa, Artificial Sequence
  Made in Lab - synthesized CDRH3 sequence of binders against hRNF43/ZNRF3
CARSFGVAGTLDYW

SEQ ID NO: 405 - protein, 14 aa, Artificial Sequence
  Made in Lab - synthesized CDRH3 sequence of binders against hRNF43/ZNRF3
CARSGAGMWYFDLW

SEQ ID NO: 406 - protein, 14 aa, Artificial Sequence
  Made in Lab - synthesized CDRH3 sequence of binders against hRNF43/ZNRF3
CARVLRGSLGFDYW

SEQ ID NO: 407 - protein, 14 aa, Artificial Sequence
  Made in Lab - synthesized CDRH3 sequence of binders against hRNF43/ZNRF3
CARVVRAVDAFDIW

SEQ ID NO: 408 - protein, 15 aa, Artificial Sequence
  Made in Lab - synthesized CDRH3 sequence of binders against hRNF43/ZNRF3
CARYSSSWSWPFDYW

SEQ ID NO: 409 - protein, 17 aa, Artificial Sequence
  Made in Lab - synthesized CDRH3 sequence of binders against hRNF43/ZNRF3
CTRARGQRSGYSYFDLW

SEQ ID NO: 410 - protein, 15 aa, Artificial Sequence
  Made in Lab - synthesized CDRH3 sequence of binders against hRNF43/ZNRF3
CVGGRSGWIWYFDLW

SEQ ID NO: 411 - protein, 9 aa, Artificial Sequence
  Made in Lab - synthesized CDRH3 sequence of binders against hRNF43/ZNRF3
GGGYYGMDY

SEQ ID NO: 412 - protein, 8 aa, Artificial Sequence
  Made in Lab - synthesized CDRH3 sequence of binders against hRNF43/ZNRF3
SRTTALDY

SEQ ID NO: 413 - protein, 11 aa, Artificial Sequence
  Made in Lab - synthesized CDRL1 sequence of binders against hRNF43/ZNRF3
KASQSVRPAVA

SEQ ID NO: 414 - protein, 17 aa, Artificial Sequence
  Made in Lab - synthesized CDRL1 sequence of binders against hRNF43/ZNRF3
KSSQSVLYSSNNKNYLA

SEQ ID NO: 415 - protein, 11 aa, Artificial Sequence
  Made in Lab - synthesized CDRL1 sequence of binders against hRNF43/ZNRF3
QASQDISRYLN

SEQ ID NO: 416 - protein, 11 aa, Artificial Sequence
  Made in Lab - synthesized CDRL1 sequence of binders against hRNF43/ZNRF3
RAGQSISRFLN

SEQ ID NO: 417 - protein, 11 aa, Artificial Sequence
  Made in Lab - synthesized CDRL1 sequence of binders against hRNF43/ZNRF3
RASENIHKYLN

SEQ ID NO: 418 - protein, 15 aa, Artificial Sequence
  Made in Lab - synthesized CDRL1 sequence of binders against hRNF43/ZNRF3
RASESVDSYGNSFMH

SEQ ID NO: 419 - protein, 11 aa, Artificial Sequence
  Made in Lab - synthesized CDRL1 sequence of binders against hRNF43/ZNRF3
RASQDISNSLN

SEQ ID NO: 420 - protein, 11 aa, Artificial Sequence
  Made in Lab - synthesized CDRL1 sequence of binders against hRNF43/ZNRF3
RASQDISRYLA

SEQ ID NO: 421 - protein, 11 aa, Artificial Sequence
  Made in Lab - synthesized CDRL1 sequence of binders against hRNF43/ZNRF3
RASQDIYRYLN

SEQ ID NO: 422 - protein, 11 aa, Artificial Sequence
  Made in Lab - synthesized CDRL1 sequence of binders against hRNF43/ZNRF3
RASQFISTYLN

SEQ ID NO: 423 - protein, 11 aa, Artificial Sequence
  Made in Lab - synthesized CDRL1 sequence of binders against hRNF43/ZNRF3
RASQGISNNLN

SEQ ID NO: 424 - protein, 11 aa, Artificial Sequence
  Made in Lab - synthesized CDRL1 sequence of binders against hRNF43/ZNRF3
RASQGISNYLA

SEQ ID NO: 425 - protein, 11 aa, Artificial Sequence
  Made in Lab - synthesized CDRL1 sequence of binders against hRNF43/ZNRF3
RASQNIRSWLA

SEQ ID NO: 426 - protein, 11 aa, Artificial Sequence
  Made in Lab - synthesized CDRL1 sequence of binders against hRNF43/ZNRF3
RASQNIYDWLA

SEQ ID NO: 427 - protein, 11 aa, Artificial Sequence
  Made in Lab - synthesized CDRL1 sequence of binders against hRNF43/ZNRF3
RASQSINNWLA

SEQ ID NO: 428 - protein, 11 aa, Artificial Sequence
  Made in Lab - synthesized CDRL1 sequence of binders against hRNF43/ZNRF3
RASQSIRSYLN

SEQ ID NO: 429 - protein, 11 aa, Artificial Sequence
  Made in Lab - synthesized CDRL1 sequence of binders against hRNF43/ZNRF3
RASQSISRWLA

SEQ ID NO: 430 - protein, 11 aa, Artificial Sequence
  Made in Lab - synthesized CDRL1 sequence of binders against hRNF43/ZNRF3
RASQSISSWLA

SEQ ID NO: 431 - protein, 11 aa, Artificial Sequence
  Made in Lab - synthesized CDRL1 sequence of binders against hRNF43/ZNRF3
RASQSISSYLN

SEQ ID NO: 432 - protein, 11 aa, Artificial Sequence
  Made in Lab - synthesized CDRL1 sequence of binders against hRNF43/ZNRF3
RASQSISTWLA

SEQ ID NO: 433 - protein, 12 aa, Artificial Sequence
  Made in Lab - synthesized CDRL1 sequence of binders against hRNF43/ZNRF3
RASQSVDSSYLA

SEQ ID NO: 434 - protein, 12 aa, Artificial Sequence
  Made in Lab - synthesized CDRL1 sequence of binders against hRNF43/ZNRF3
RASQSVNSRYLA

SEQ ID NO: 435 - protein, 11 aa, Artificial Sequence
  Made in Lab - synthesized CDRL1 sequence of binders against hRNF43/ZNRF3
RASQSVSASLA

SEQ ID NO: 436 - protein, 12 aa, Artificial Sequence
  Made in Lab - synthesized CDRL1 sequence of binders against hRNF43/ZNRF3
RASQSVSSSNLA

SEQ ID NO: 437 - protein, 12 aa, Artificial Sequence
  Made in Lab - synthesized CDRL1 sequence of binders against hRNF43/ZNRF3
RASQSVSSSYLA

SEQ ID NO: 438 - protein, 11 aa, Artificial Sequence
  Made in Lab - synthesized CDRL1 sequence of binders against hRNF43/ZNRF3
RASQYIGSYLN

SEQ ID NO: 439 - protein, 11 aa, Artificial Sequence
  Made in Lab - synthesized CDRL1 sequence of binders against hRNF43/ZNRF3
RSSQSIRTYLN

SEQ ID NO: 440 - protein, 16 aa, Artificial Sequence
  Made in Lab - synthesized CDRL1 sequence of binders against hRNF43/ZNRF3
RSSQSLLHSNGYNYLD

SEQ ID NO: 441 - protein, 11 aa, Artificial Sequence
  Made in Lab - synthesized CDRL1 sequence of binders against hRNF43/ZNRF3
RVSQGISSYLN

SEQ ID NO: 442 - protein, 11 aa, Artificial Sequence
  Made in Lab - synthesized CDRL1 sequence of binders against hRNF43/ZNRF3
SGDSLGSYYVH

SEQ ID NO: 443 - protein, 17 aa, Artificial Sequence
  Made in Lab - synthesized CDRL1 sequence of binders against hRNF43/ZNRF3
TSSQSVLHSSNKKNYLA

SEQ ID NO: 444 - protein, 7 aa, Artificial Sequence
  Made in Lab - synthesized CDRL2 sequence of binders against hRNF43/ZNRF3
AASARAA

SEQ ID NO: 445 - protein, 7 aa, Artificial Sequence
  Made in Lab - synthesized CDRL2 sequence of binders against hRNF43/ZNRF3
AASSLHS

SEQ ID NO: 446 - protein, 7 aa, Artificial Sequence
  Made in Lab - synthesized CDRL2 sequence of binders against hRNF43/ZNRF3
AASSLQR

SEQ ID NO: 447 - protein, 7 aa, Artificial Sequence
  Made in Lab - synthesized CDRL2 sequence of binders against hRNF43/ZNRF3
AASSLQS

SEQ ID NO: 448 - protein, 7 aa, Artificial Sequence
  Made in Lab - synthesized CDRL2 sequence of binders against hRNF43/ZNRF3
AASTLQS

SEQ ID NO: 449 - protein, 7 aa, Artificial Sequence
  Made in Lab - synthesized CDRL2 sequence of binders against hRNF43/ZNRF3
AASTVES

SEQ ID NO: 450 - protein, 7 aa, Artificial Sequence
  Made in Lab - synthesized CDRL2 sequence of binders against hRNF43/ZNRF3
ATSTRAT

SEQ ID NO: 451 - protein, 7 aa, Artificial Sequence
  Made in Lab - synthesized CDRL2 sequence of binders against hRNF43/ZNRF3
DASNLET

SEQ ID NO: 452 - protein, 7 aa, Artificial Sequence
  Made in Lab - synthesized CDRL2 sequence of binders against hRNF43/ZNRF3
DASSLET

SEQ ID NO: 453 - protein, 7 aa, Artificial Sequence
  Made in Lab - synthesized CDRL2 sequence of binders against hRNF43/ZNRF3
DASSLPS

SEQ ID NO: 454 - protein, 7 aa, Artificial Sequence
  Made in Lab - synthesized CDRL2 sequence of binders against hRNF43/ZNRF3
DASSLQR

SEQ ID NO: 455 - protein, 7 aa, Artificial Sequence
  Made in Lab - synthesized CDRL2 sequence of binders against hRNF43/ZNRF3
GASSLQS

SEQ ID NO: 456 - protein, 7 aa, Artificial Sequence
  Made in Lab - synthesized CDRL2 sequence of binders against hRNF43/ZNRF3
GASSRAT

SEQ ID NO: 457 - protein, 7 aa, Artificial Sequence
  Made in Lab - synthesized CDRL2 sequence of binders against hRNF43/ZNRF3
GASTRAT

SEQ ID NO: 458 - protein, 7 aa, Artificial Sequence
  Made in Lab - synthesized CDRL2 sequence of binders against hRNF43/ZNRF3
KASSLES

SEQ ID NO: 459 - protein, 7 aa, Artificial Sequence
  Made in Lab - synthesized CDRL2 sequence of binders against hRNF43/ZNRF3
LASNLES

SEQ ID NO: 460 - protein, 7 aa, Artificial Sequence
  Made in Lab - synthesized CDRL2 sequence of binders against hRNF43/ZNRF3
LASNRHT

SEQ ID NO: 461 - protein, 7 aa, Artificial Sequence
  Made in Lab - synthesized CDRL2 sequence of binders against hRNF43/ZNRF3
LGSNRAS

SEQ ID NO: 462 - protein, 7 aa, Artificial Sequence
  Made in Lab - synthesized CDRL2 sequence of binders against hRNF43/ZNRF3
LGSYRAS

SEQ ID NO: 463 - protein, 7 aa, Artificial Sequence
  Made in Lab - synthesized CDRL2 sequence of binders against hRNF43/ZNRF3
RNKQRPS

SEQ ID NO: 464 - protein, 7 aa, Artificial Sequence
  Made in Lab - synthesized CDRL2 sequence of binders against hRNF43/ZNRF3
WASTRAS

SEQ ID NO: 465 - protein, 7 aa, Artificial Sequence
  Made in Lab - synthesized CDRL2 sequence of binders against hRNF43/ZNRF3
WASTRES

SEQ ID NO: 466 - protein, 11 aa, Artificial Sequence
  Made in Lab - synthesized CDRL3 sequence of binders against hRNF43/ZNRF3
CHQYFSPPMTF

SEQ ID NO: 467 - protein, 11 aa, Artificial Sequence [sequence omitted]

SEQ ID NO: 468 - protein, 11 aa, Artificial Sequence [sequence omitted]

SEQ ID NO: 469 - protein, 11 aa, Artificial Sequence [sequence omitted]

SEQ ID NO: 470 - protein, 11 aa, Artificial Sequence [sequence omitted]

SEQ ID NO: 471 - protein, 11 aa, Artificial Sequence
  Made in Lab - synthesized CDRL3 sequence of binders against hRNF43/ZNRF3
CMQSLEAPLAF

SEQ ID NO: 472 - protein, 11 aa, Artificial Sequence [sequence omitted]

SEQ ID NO: 473 - protein, 11 aa, Artificial Sequence [sequence omitted]

SEQ ID NO: 474 - protein, 11 aa, Artificial Sequence [sequence omitted]

SEQ ID NO: 475 - protein, 11 aa, Artificial Sequence
  Made in Lab - synthesized CDRL3 sequence of binders against hRNF43/ZNRF3
CQQAYSFPWTF

SEQ ID NO: 476 - protein, 11 aa, Artificial Sequence [sequence omitted]

SEQ ID NO: 477 - protein, 11 aa, Artificial Sequence [sequence omitted]

SEQ ID NO: 478 - protein, 11 aa, Artificial Sequence [sequence omitted]

SEQ ID NO: 479 - protein, 11 aa, Artificial Sequence [sequence omitted]

SEQ ID NO: 480 - protein, 11 aa, Artificial Sequence [sequence omitted]

SEQ ID NO: 481 - protein, 11 aa, Artificial Sequence [sequence omitted]

SEQ ID NO: 482 - protein, 11 aa, Artificial Sequence [sequence omitted]

SEQ ID NO: 483 - protein, 11 aa, Artificial Sequence [sequence omitted]

SEQ ID NO: 484 - protein, 11 aa, Artificial Sequence
  Made in Lab - synthesized CDRL3 sequence of binders against hRNF43/ZNRF3
CQQSYSRPFTF

SEQ ID NO: 485 - protein, 11 aa, Artificial Sequence [sequence omitted]

SEQ ID NO: 486 - protein, 11 aa, Artificial Sequence [sequence omitted]

SEQ ID NO: 487 - protein, 11 aa, Artificial Sequence
  Made in Lab - synthesized CDRL3 sequence of binders against hRNF43/ZNRF3
CQQSYSTPPTF

SEQ ID NO: 488 - protein, 10 aa, Artificial Sequence [sequence omitted]

SEQ ID NO: 489 - protein, 11 aa, Artificial Sequence [sequence omitted]

SEQ ID NO: 490 - protein, 11 aa, Artificial Sequence [sequence omitted]

SEQ ID NO: 491 - protein, 11 aa, Artificial Sequence [sequence omitted]

SEQ ID NO: 492 - protein, 11 aa, Artificial Sequence [sequence omitted]

SEQ ID NO: 493 - protein, 11 aa, Artificial Sequence [sequence omitted]

SEQ ID NO: 494 - protein, 11 aa, Artificial Sequence [sequence omitted]

SEQ ID NO: 495 - protein, 11 aa, Artificial Sequence [sequence omitted]

SEQ ID NO: 496 - protein, 11 aa, Artificial Sequence [sequence omitted]

SEQ ID NO: 497 - protein, 11 aa, Artificial Sequence [sequence omitted]

SEQ ID NO: 498 - protein, 11 aa, Artificial Sequence [sequence omitted]

SEQ ID NO: 499 - protein, 11 aa, Artificial Sequence [sequence omitted]

SEQ ID NO: 500 - protein, 11 aa, Artificial Sequence [sequence omitted]

SEQ ID NO: 501 - protein, 9 aa, Artificial Sequence
  Made in Lab - synthesized CDRL3 sequence of binders against hRNF43/ZNRF3
LQHWNYPYT

SEQ ID NO: 502 - protein, 9 aa, Artificial Sequence
  Made in Lab - synthesized CDRL3 sequence of binders against hRNF43/ZNRF3
QQNNEDPLT

SEQ ID NO: 503 - protein, 11 aa, Artificial Sequence
  Made in Lab - synthesized CDRL3 sequence of binders against hRNF43/ZNRF3
QTYDWMYSSRV

SEQ ID NO: 504 - protein, 11 aa, Artificial Sequence
  Made in Lab - synthesized CDRH1 sequence of binders against hASGR1/2
ASVSSNSAAWN

SEQ ID NO: 505 - protein, 11 aa, Artificial Sequence
  Made in Lab - synthesized CDRH1 sequence of binders against hASGR1/2
DSVSSNSAAWN

SEQ ID NO: 506 - protein, 11 aa, Artificial Sequence
  Made in Lab - synthesized CDRH1 sequence of binders against hASGR1/2
FSLSTSYMGVS

SEQ ID NO: 507 - protein, 9 aa, Artificial Sequence
  Made in Lab - synthesized CDRH1 sequence of binders against hASGR1/2
FTFSDYGMH

SEQ ID NO: 508 - protein, 9 aa, Artificial Sequence
  Made in Lab - synthesized CDRH1 sequence of binders against hASGR1/2
FTFSSYAMS

SEQ ID NO: 509 - protein, 9 aa, Artificial Sequence
  Made in Lab - synthesized CDRH1 sequence of binders against hASGR1/2
FTFSSYAMS

SEQ ID NO: 510 - protein, 9 aa, Artificial Sequence
  Made in Lab - synthesized CDRH1 sequence of binders against hASGR1/2
FTFSSYGMS

SEQ ID NO: 511 - protein, 9 aa, Artificial Sequence
  Made in Lab - synthesized CDRH1 sequence of binders against hASGR1/2
FTFSTYTMS

SEQ ID NO: 512 - protein, 9 aa, Artificial Sequence
  Made in Lab - synthesized CDRH1 sequence of binders against hASGR1/2
FTFTDYYMN

SEQ ID NO: 513 - protein, 9 aa, Artificial Sequence
  Made in Lab - synthesized CDRH1 sequence of binders against hASGR1/2
FTFTDYYMS

SEQ ID NO: 514 - protein, 9 aa, Artificial Sequence
  Made in Lab - synthesized CDRH1 sequence of binders against hASGR1/2
FTVSSNYMS

SEQ ID NO: 515 - protein, 7 aa, Artificial Sequence
  Made in Lab - synthesized CDRH1 sequence of binders against hASGR1/2
GFSFNTY

SEQ ID NO: 516 - protein, 7 aa, Artificial Sequence
  Made in Lab - synthesized CDRH1 sequence of binders against hASGR1/2
GFTFSSY

SEQ ID NO: 517 - protein, 9 aa, Artificial Sequence
  Made in Lab - synthesized CDRH1 sequence of binders against hASGR1/2
GTFSSYAIS

SEQ ID NO: 518 - protein, 9 aa, Artificial Sequence
  Made in Lab - synthesized CDRH1 sequence of binders against hASGR1/2
HTFSSYAMG

SEQ ID NO: 519 - protein, 9 aa, Artificial Sequence
  Made in Lab - synthesized CDRH1 sequence of binders against hASGR1/2
YSFTDYFMN

SEQ ID NO: 520 - protein, 9 aa, Artificial Sequence
  Made in Lab - synthesized CDRH1 sequence of binders against hASGR1/2
YSFTGNYMH

SEQ ID NO: 521 - protein, 9 aa, Artificial Sequence
  Made in Lab - synthesized CDRH1 sequence of binders against hASGR1/2
YSFTGYFMN

SEQ ID NO: 522 - protein, 10 aa, Artificial Sequence
  Made in Lab - synthesized CDRH1 sequence of binders against hASGR1/2
YSITSGYYWN

SEQ ID NO: 523 - protein, 9 aa, Artificial Sequence
  Made in Lab - synthesized CDRH1 sequence of binders against hASGR1/2
YTFLTYWMN

SEQ ID NO: 524 - protein, 9 aa, Artificial Sequence
  Made in Lab - synthesized CDRH1 sequence of binders against hASGR1/2
YTFSDYYVH

SEQ ID NO: 525 - protein, 9 aa, Artificial Sequence
  Made in Lab - synthesized CDRH1 sequence of binders against hASGR1/2
YTFSNYYMH

SEQ ID NO: 526 - protein, 9 aa, Artificial Sequence
  Made in Lab - synthesized CDRH1 sequence of binders against hASGR1/2
YTFSRFDMH

SEQ ID NO: 527 - protein, 9 aa, Artificial Sequence
  Made in Lab - synthesized CDRH1 sequence of binders against hASGR1/2
YTFTDYNMH

SEQ ID NO: 528 - protein, 9 aa, Artificial Sequence
  Made in Lab - synthesized CDRH1 sequence of binders against hASGR1/2
YTFTDYYIN

SEQ ID NO: 529 - protein, 9 aa, Artificial Sequence
  Made in Lab - synthesized CDRH1 sequence of binders against hASGR1/2
YTFTDYYMN

SEQ ID NO: 530 - protein, 9 aa, Artificial Sequence
  Made in Lab - synthesized CDRH1 sequence of binders against hASGR1/2
YTFTGYHMH

SEQ ID NO: 531 - protein, 9 aa, Artificial Sequence
  Made in Lab - synthesized CDRH1 sequence of binders against hASGR1/2
YTFTGYYMH

SEQ ID NO: 532 - protein, 9 aa, Artificial Sequence
  Made in Lab - synthesized CDRH1 sequence of binders against hASGR1/2
YTFTNYGIN

SEQ ID NO: 533 - protein, 9 aa, Artificial Sequence
  Made in Lab - synthesized CDRH1 sequence of binders against hASGR1/2
YTFTSYGIS

SEQ ID NO: 534 - protein, 9 aa, Artificial Sequence
  Made in Lab - synthesized CDRH1 sequence of binders against hASGR1/2
YTFTSYWIH

SEQ ID NO: 535 - protein, 9 aa, Artificial Sequence
  Made in Lab - synthesized CDRH1 sequence of binders against hASGR1/2
YTFTTYYMH

SEQ ID NO: 536 - protein, 13 aa, Artificial Sequence
  Made in Lab - synthesized CDRH2 sequence of binders against hASGR1/2
AAISQSGYVRYYA

SEQ ID NO: 537 - protein, 12 aa, Artificial Sequence
  Made in Lab - synthesized CDRH2 sequence of binders against hASGR1/2
AHIFWDDDKRYN

SEQ ID NO: 538 - protein, 12 aa, Artificial Sequence
  Made in Lab - synthesized CDRH2 sequence of binders against hASGR1/2
AISGSGGSTYYA

SEQ ID NO: 539 - protein, 15 aa, Artificial Sequence
  Made in Lab - synthesized CDRH2 sequence of binders against hASGR1/2
ALIRNKANGYTTEYS

SEQ ID NO: 540 - protein, 13 aa, Artificial Sequence
  Made in Lab - synthesized CDRH2 sequence of binders against hASGR1/2
ASISSGGSYTYYP

SEQ ID NO: 541 - protein, 13 aa, Artificial Sequence
  Made in Lab - synthesized CDRH2 sequence of binders against hASGR1/2
ATISSIGVNTYYP

SEQ ID NO: 542 - protein, 13 aa, Artificial Sequence
  Made in Lab - synthesized CDRH2 sequence of binders against hASGR1/2
AYISSGSSTIYYA

SEQ ID NO: 543 - protein, 13 aa, Artificial Sequence
  Made in Lab - synthesized CDRH2 sequence of binders against hASGR1/2
GEIFPRSDNTFYN

SEQ ID NO: 544 - protein, 13 aa, Artificial Sequence
  Made in Lab - synthesized CDRH2 sequence of binders against hASGR1/2
GGIIPIFGTANYA

SEQ ID NO: 545 - protein, 13 aa, Artificial Sequence
  Made in Lab - synthesized CDRH2 sequence of binders against hASGR1/2
GGIIPMFGTVKYA

SEQ ID NO: 546 - protein, 13 aa, Artificial Sequence
  Made in Lab - synthesized CDRH2 sequence of binders against hASGR1/2
GGIIPVFGAPNYA

SEQ ID NO: 547 - protein, 13 aa, Artificial Sequence
  Made in Lab - synthesized CDRH2 sequence of binders against hASGR1/2
GIINPRNGRTSYA

SEQ ID NO: 548 - protein, 13 aa, Artificial Sequence
  Made in Lab - synthesized CDRH2 sequence of binders against hASGR1/2
GIINPSGGGTSYA

SEQ ID NO: 549 - protein, 13 aa, Artificial Sequence
  Made in Lab - synthesized CDRH2 sequence of binders against hASGR1/2
GQIFPATGITYYS

SEQ ID NO: 550 - protein, 13 aa, Artificial Sequence
  Made in Lab - synthesized CDRH2 sequence of binders against hASGR1/2
GRFNPFNGQTFYN

SEQ ID NO: 551 - protein, 14 aa, Artificial Sequence
  Made in Lab - synthesized CDRH2 sequence of binders against hASGR1/2
GRTYYRSKWYNDYA

SEQ ID NO: 552 - protein, 14 aa, Artificial Sequence
  Made in Lab - synthesized CDRH2 sequence of binders against hASGR1/2
GRTYYRSKWYYDYA

SEQ ID NO: 553 - protein, 13 aa, Artificial Sequence
  Made in Lab - synthesized CDRH2 sequence of binders against hASGR1/2
GRVIPSNGGSNYN

SEQ ID NO: 554 - protein, 13 aa, Artificial Sequence
  Made in Lab - synthesized CDRH2 sequence of binders against hASGR1/2
GRVIPSNGGTNYN

SEQ ID NO: 555 - protein, 13 aa, Artificial Sequence
  Made in Lab - synthesized CDRH2 sequence of binders against hASGR1/2
GRVNPNNGGSNYN

SEQ ID NO: 556 - protein, 13 aa, Artificial Sequence
  Made in Lab - synthesized CDRH2 sequence of binders against hASGR1/2
GRVNPSNDDTRYN

SEQ ID NO: 557 - protein, 12 aa, Artificial Sequence
  Made in Lab - synthesized CDRH2 sequence of binders against hASGR1/2
GSIGYDDTNHYN

SEQ ID NO: 558 - protein, 13 aa, Artificial Sequence
  Made in Lab - synthesized CDRH2 sequence of binders against hASGR1/2
GVIYPGNGDTSYN

SEQ ID NO: 559 - protein, 13 aa, Artificial Sequence
  Made in Lab - synthesized CDRH2 sequence of binders against hASGR1/2
GWINPKSGGTKYA

SEQ ID NO: 560 - protein, 13 aa, Artificial Sequence
  Made in Lab - synthesized CDRH2 sequence of binders against hASGR1/2
GWINPNGGGTNYA

SEQ ID NO: 561 - protein, 13 aa, Artificial Sequence
  Made in Lab - synthesized CDRH2 sequence of binders against hASGR1/2
GWISAYNGNTNYA

SEQ ID NO: 562 - protein, 13 aa, Artificial Sequence
  Made in Lab - synthesized CDRH2 sequence of binders against hASGR1/2
GWMNPNTGNTAYA

SEQ ID NO: 563 - protein, 13 aa, Artificial Sequence
  Made in Lab - synthesized CDRH2 sequence of binders against hASGR1/2
GYINPSSGYAEYN

SEQ ID NO: 564 - protein, 8 aa, Artificial Sequence
  Made in Lab - synthesized CDRH2 sequence of binders against hASGR1/2
RSKSNNYA

SEQ ID NO: 565 - protein, 13 aa, Artificial Sequence
  Made in Lab - synthesized CDRH2 sequence of binders against hASGR1/2
SAISGSGGSTYYA

SEQ ID NO: 566 - protein, 6 aa, Artificial Sequence
  Made in Lab - synthesized CDRH2 sequence of binders against hASGR1/2
SGSGGS

SEQ ID NO: 567 - protein, 6 aa, Artificial Sequence
  Made in Lab - synthesized CDRH2 sequence of binders against hASGR1/2
SSGGDY

SEQ ID NO: 568 - protein, 13 aa, Artificial Sequence
  Made in Lab - synthesized CDRH2 sequence of binders against hASGR1/2
SYISSYNSHTNDA

SEQ ID NO: 569 - protein, 10 aa, Artificial Sequence
  Made in Lab - synthesized CDRH3 sequence of binders against hASGR1/2
CAGDYPFAFW

SEQ ID NO: 570 - protein, 14 aa, Artificial Sequence
  Made in Lab - synthesized CDRH3 sequence of binders against hASGR1/2
CAKDRGYRFDFDLW

SEQ ID NO: 571 - protein, 17 aa, Artificial Sequence
  Made in Lab - synthesized CDRH3 sequence of binders against hASGR1/2
CAKDRTAMAPEGAFDIW

SEQ ID NO: 572 - protein, 22 aa, Artificial Sequence
  Made in Lab - synthesized CDRH3 sequence of binders against hASGR1/2
CAKDSPIVRRGERGRYYGMDVW

SEQ ID NO: 573 - protein, 15 aa, Artificial Sequence
  Made in Lab - synthesized CDRH3 sequence of binders against hASGR1/2
CAKSSFSYLRAFDYW

SEQ ID NO: 574 - protein, 15 aa, Artificial Sequence
  Made in Lab - synthesized CDRH3 sequence of binders against hASGR1/2
CAKSSFTFGRYFDYW

SEQ ID NO: 575 - protein, 15 aa, Artificial Sequence
  Made in Lab - synthesized CDRH3 sequence of binders against hASGR1/2
CAKSWYLPGRGFDYW

SEQ ID NO: 576 - protein, 12 aa, Artificial Sequence
  Made in Lab - synthesized CDRH3 sequence of binders against hASGR1/2
CARDGGYGMDVW

SEQ ID NO: 577 - protein, 12 aa, Artificial Sequence
  Made in Lab - synthesized CDRH3 sequence of binders against hASGR1/2
CARDHLYGMDVW

SEQ ID NO: 578 - protein, 13 aa, Artificial Sequence
  Made in Lab - synthesized CDRH3 sequence of binders against hASGR1/2
CARDKNYYGMDVW

SEQ ID NO: 579 - protein, 17 aa, Artificial Sequence
  Made in Lab - synthesized CDRH3 sequence of binders against hASGR1/2
CARDRGITMVRGVMDYW

SEQ ID NO: 580 - protein, 15 aa, Artificial Sequence
  Made in Lab - synthesized CDRH3 sequence of binders against hASGR1/2
CARDTGATAEYFQHW

SEQ ID NO: 581 - protein, 16 aa, Artificial Sequence
  Made in Lab - synthesized CDRH3 sequence of binders against hASGR1/2
CARESYYSFDYTMDYW

SEQ ID NO: 582 - protein, 8 aa, Artificial Sequence
  Made in Lab - synthesized CDRH3 sequence of binders against hASGR1/2
CARGMDYW

SEQ ID NO: 583 - protein, 16 aa, Artificial Sequence
  Made in Lab - synthesized CDRH3 sequence of binders against hASGR1/2
CARHVDYYDGISFDYW

SEQ ID NO: 584 - protein, 17 aa, Artificial Sequence
  Made in Lab - synthesized CDRH3 sequence of binders against hASGR1/2
CARKGRDYGTSHYFDYW

SEQ ID NO: 585 - protein, 16 aa, Artificial Sequence
  Made in Lab - synthesized CDRH3 sequence of binders against hASGR1/2
CARRGRYDVYYALDYW

SEQ ID NO: 586 - protein, 16 aa, Artificial Sequence
  Made in Lab - synthesized CDRH3 sequence of binders against hASGR1/2
CARRGRYDVYYVLDYW

SEQ ID NO: 587 - protein, 15 aa, Artificial Sequence
  Made in Lab - synthesized CDRH3 sequence of binders against hASGR1/2
CARRRAYHSNFFDYW

SEQ ID NO: 588 - protein, 18 aa, Artificial Sequence
  Made in Lab - synthesized CDRH3 sequence of binders against hASGR1/2
CARWAVAAGGQYYYMDVW

SEQ ID NO: 589 - protein, 14 aa, Artificial Sequence
  Made in Lab - synthesized CDRH3 sequence of binders against hASGR1/2
CARWNHEEHYFDYW

SEQ ID NO: 590 - protein, 9 aa, Artificial Sequence
  Made in Lab - synthesized CDRH3 sequence of binders against hASGR1/2
CASAGGGYW

SEQ ID NO: 591 - protein, 12 aa, Artificial Sequence
  Made in Lab - synthesized CDRH3 sequence of binders against hASGR1/2
CASFGVGAPDYW

SEQ ID NO: 592 - protein, 9 aa, Artificial Sequence
  Made in Lab - synthesized CDRH3 sequence of binders against hASGR1/2
CASRNFDVW

SEQ ID NO: 593 - protein, 10 aa, Artificial Sequence
  Made in Lab - synthesized CDRH3 sequence of binders against hASGR1/2
CASSYYGNPW

SEQ ID NO: 594 - protein, 12 aa, Artificial Sequence
  Made in Lab - synthesized CDRH3 sequence of binders against hASGR1/2
CASWTRGAFDIW

SEQ ID NO: 595 - protein, 8 aa, Artificial Sequence
  Made in Lab - synthesized CDRH3 sequence of binders against hASGR1/2
CATQLGRW

SEQ ID NO: 596 - protein, 12 aa, Artificial Sequence
  Made in Lab - synthesized CDRH3 sequence of binders against hASGR1/2
CAVSDGYDLDYW

SEQ ID NO: 597 - protein, 9 aa, Artificial Sequence
  Made in Lab - synthesized CDRH3 sequence of binders against hASGR1/2
CAVTYGAYW

SEQ ID NO: 598 - protein, 11 aa, Artificial Sequence
  Made in Lab - synthesized CDRH3 sequence of binders against hASGR1/2
CGGPYYPFTYW

SEQ ID NO: 599 - protein, 14 aa, Artificial Sequence
  Made in Lab - synthesized CDRH3 sequence of binders against hASGR1/2
CNARWGAGSLFASW

SEQ ID NO: 600 - protein, 19 aa, Artificial Sequence
  Made in Lab - synthesized CDRH3 sequence of binders against hASGR1/2
CSRKGGFGDYEKSYAMDYW

SEQ ID NO: 601 - protein, 10 aa, Artificial Sequence
  Made in Lab - synthesized CDRH3 sequence of binders against hASGR1/2
CTRWFYFDYW

SEQ ID NO: 602 - protein, 15 aa, Artificial Sequence
  Made in Lab - synthesized CDRH3 sequence of binders against hASGR1/2
CVRHEEYGKSGFAYW

SEQ ID NO: 603 - protein, 11 aa, Artificial Sequence
  Made in Lab - synthesized CDRH3 sequence of binders against hASGR1/2
DFSSRRWYLEY

SEQ ID NO: 604 - protein, 8 aa, Artificial Sequence
  Made in Lab - synthesized CDRH3 sequence of binders against hASGR1/2
EGTGGMDY

SEQ ID NO: 605 - protein, 10 aa, Artificial Sequence
  Made in Lab - synthesized CDRH3 sequence of binders against hASGR1/2
PRYDYWYFDV

SEQ ID NO: 606 - protein, 11 aa, Artificial Sequence
  Made in Lab - synthesized CDRL1 sequence of binders against hASGR1/2
KASQDINSHLS

SEQ ID NO: 607 - protein, 11 aa, Artificial Sequence
  Made in Lab - synthesized CDRL1 sequence of binders against hASGR1/2
KASQDINSYLS

SEQ ID NO: 608 - protein, 11 aa, Artificial Sequence
  Made in Lab - synthesized CDRL1 sequence of binders against hASGR1/2
KASQNVGSNVA

SEQ ID NO: 609 - protein, 11 aa, Artificial Sequence
  Made in Lab - synthesized CDRL1 sequence of binders against hASGR1/2
KASQNVGTNVA

SEQ ID NO: 610 - protein, 17 aa, Artificial Sequence
  Made in Lab - synthesized CDRL1 sequence of binders against hASGR1/2
KSSQSLFNSRTRKNYLA

SEQ ID NO: 611 - protein, 16 aa, Artificial Sequence
  Made in Lab - synthesized CDRL1 sequence of binders against hASGR1/2
KSSQSLLDSDGKTYLN

SEQ ID NO: 612 - protein, 16 aa, Artificial Sequence
  Made in Lab - synthesized CDRL1 sequence of binders against hASGR1/2
KSSQSLLDSDGKTYLN

SEQ ID NO: 613 - protein, 11 aa, Artificial Sequence
  Made in Lab - synthesized CDRL1 sequence of binders against hASGR1/2
QGDSLRSYYAS

SEQ ID NO: 614 - protein, 11 aa, Artificial Sequence
  Made in Lab - synthesized CDRL1 sequence of binders against hASGR1/2
RASENIYSNLA

SEQ ID NO: 615 - protein, 11 aa, Artificial Sequence
  Made in Lab - synthesized CDRL1 sequence of binders against hASGR1/2
RASENIYSYLV

SEQ ID NO: 616 - protein, 11 aa, Artificial Sequence
  Made in Lab - synthesized CDRL1 sequence of binders against hASGR1/2
RASQGIATWLA

SEQ ID NO: 617 - protein, 11 aa, Artificial Sequence
  Made in Lab - synthesized CDRL1 sequence of binders against hASGR1/2
RASQGISSWLA

SEQ ID NO: 618 - protein, 11 aa, Artificial Sequence
  Made in Lab - synthesized CDRL1 sequence of binders against hASGR1/2
RASQNIYTYLN

SEQ ID NO: 619 - protein, 11 aa, Artificial Sequence
  Made in Lab - synthesized CDRL1 sequence of binders against hASGR1/2
RASQSINNYLN

SEQ ID NO: 620 - protein, 11 aa, Artificial Sequence
  Made in Lab - synthesized CDRL1 sequence of binders against hASGR1/2
RASQSISNWLA

SEQ ID NO: 621 - protein, 11 aa, Artificial Sequence
  Made in Lab - synthesized CDRL1 sequence of binders against hASGR1/2
RASQSISNYLH

SEQ ID NO: 622 - protein, 11 aa, Artificial Sequence
  Made in Lab - synthesized CDRL1 sequence of binders against hASGR1/2
RASQSISRYLN

SEQ ID NO: 623 - protein, 11 aa, Artificial Sequence
  Made in Lab - synthesized CDRL1 sequence of binders against hASGR1/2
RASQSISSWLA

SEQ ID NO: 624 - protein, 11 aa, Artificial Sequence
  Made in Lab - synthesized CDRL1 sequence of binders against hASGR1/2
RASQSISSYLN

SEQ ID NO: 625 - protein, 11 aa, Artificial Sequence
  Made in Lab - synthesized CDRL1 sequence of binders against hASGR1/2
RASQSVGSYLA

SEQ ID NO: 626 - protein, 11 aa, Artificial Sequence
  Made in Lab - synthesized CDRL1 sequence of binders against hASGR1/2
RASQSVSSYLA

SEQ ID NO: 627 - protein, 11 aa, Artificial Sequence
  Made in Lab - synthesized CDRL1 sequence of binders against hASGR1/2
RISENIYSNLA

SEQ ID NO: 628 - protein, 16 aa, Artificial Sequence
  Made in Lab - synthesized CDRL1 sequence of binders against hASGR1/2
RSSQGIVHSNGNIYLE

SEQ ID NO: 629 - protein, 16 aa, Artificial Sequence
  Made in Lab - synthesized CDRL1 sequence of binders against hASGR1/2
RSSQSLANSYGNTYLS

SEQ ID NO: 630 - protein, 16 aa, Artificial Sequence
  Made in Lab - synthesized CDRL1 sequence of binders against hASGR1/2
RSSQSLLHSDGHNYLQ

SEQ ID NO: 631 - protein, 16 aa, Artificial Sequence
  Made in Lab - synthesized CDRL1 sequence of binders against hASGR1/2
RSSQSLLHSNGYNYLD

SEQ ID NO: 632 - protein, 11 aa, Artificial Sequence
  Made in Lab - synthesized CDRL1 sequence of binders against hASGR1/2
RTSENIYSNLA

SEQ ID NO: 633 - protein, 11 aa, Artificial Sequence
  Made in Lab - synthesized CDRL1 sequence of binders against hASGR1/2
RTSENIYSYLA

SEQ ID NO: 634 - protein, 12 aa, Artificial Sequence
  Made in Lab - synthesized CDRL1 sequence of binders against hASGR1/2
SASSSVSSSFLH

SEQ ID NO: 635 - protein, 7 aa, Artificial Sequence
  Made in Lab - synthesized CDRL2 sequence of binders against hASGR1/2
AAINLAD

SEQ ID NO: 636 - protein, 7 aa, Artificial Sequence
  Made in Lab - synthesized CDRL2 sequence of binders against hASGR1/2
AASNLQS

SEQ ID NO: 637 - protein, 7 aa, Artificial Sequence
  Made in Lab - synthesized CDRL2 sequence of binders against hASGR1/2
AASRLQS

SEQ ID NO: 638 - protein, 7 aa, Artificial Sequence
  Made in Lab - synthesized CDRL2 sequence of binders against hASGR1/2
AASSLQS

SEQ ID NO: 639 - protein, 7 aa, Artificial Sequence
  Made in Lab - synthesized CDRL2 sequence of binders against hASGR1/2
AATNLAD

SEQ ID NO: 640 - protein, 7 aa, Artificial Sequence
  Made in Lab - synthesized CDRL2 sequence of binders against hASGR1/2
AATTLQS

SEQ ID NO: 641 - protein, 7 aa, Artificial Sequence
  Made in Lab - synthesized CDRL2 sequence of binders against hASGR1/2
DASNLQS

SEQ ID NO: 642 - protein, 7 aa, Artificial Sequence
  Made in Lab - synthesized CDRL2 sequence of binders against hASGR1/2
DASNLRS

SEQ ID NO: 643 - protein, 7 aa, Artificial Sequence
  Made in Lab - synthesized CDRL2 sequence of binders against hASGR1/2
DASNRAT

SEQ ID NO: 644 - protein, 7 aa, Artificial Sequence
  Made in Lab - synthesized CDRL2 sequence of binders against hASGR1/2
DATNRAT

SEQ ID NO: 645 - protein, 7 aa, Artificial Sequence
  Made in Lab - synthesized CDRL2 sequence of binders against hASGR1/2
FASQSIS

SEQ ID NO: 646 - protein, 7 aa, Artificial Sequence
  Made in Lab - synthesized CDRL2 sequence of binders against hASGR1/2
GATNLAD

SEQ ID NO: 647 - protein, 7 aa, Artificial Sequence
  Made in Lab - synthesized CDRL2 sequence of binders against hASGR1/2
GISNRFS

SEQ ID NO: 648 - protein, 7 aa, Artificial Sequence
  Made in Lab - synthesized CDRL2 sequence of binders against hASGR1/2
GKNNRPS

SEQ ID NO: 649 - protein, 7 aa, Artificial Sequence
  Made in Lab - synthesized CDRL2 sequence of binders against hASGR1/2
GRNNRPS

SEQ ID NO: 650 - protein, 7 aa, Artificial Sequence
  Made in Lab - synthesized CDRL2 sequence of binders against hASGR1/2
KVSNRFS

SEQ ID NO: 651 - protein, 7 aa, Artificial Sequence
  Made in Lab - synthesized CDRL2 sequence of binders against hASGR1/2
LGSYRAS

SEQ ID NO: 652 - protein, 7 aa, Artificial Sequence
  Made in Lab - synthesized CDRL2 sequence of binders against hASGR1/2
LVSKLDS

SEQ ID NO: 653 - protein, 7 aa, Artificial Sequence
  Made in Lab - synthesized CDRL2 sequence of binders against hASGR1/2
NAKTLAE

SEQ ID NO: 654 - protein, 7 aa, Artificial Sequence
  Made in Lab - synthesized CDRL2 sequence of binders against hASGR1/2
NAKTLAK

SEQ ID NO: 655 - protein, 7 aa, Artificial Sequence
  Made in Lab - synthesized CDRL2 sequence of binders against hASGR1/2
QASNKDT

SEQ ID NO: 656 - protein, 7 aa, Artificial Sequence
  Made in Lab - synthesized CDRL2 sequence of binders against hASGR1/2
RANRLAD

SEQ ID NO: 657 - protein, 7 aa, Artificial Sequence
  Made in Lab - synthesized CDRL2 sequence of binders against hASGR1/2
RANRLVD

SEQ ID NO: 658 - protein, 7 aa, Artificial Sequence
  Made in Lab - synthesized CDRL2 sequence of binders against hASGR1/2
RTSNLAS

SEQ ID NO: 659 - protein, 7 aa, Artificial Sequence
  Made in Lab - synthesized CDRL2 sequence of binders against hASGR1/2
SASYRYS

SEQ ID NO: 660 - protein, 7 aa, Artificial Sequence
  Made in Lab - synthesized CDRL2 sequence of binders against hASGR1/2
SSSYRYS

SEQ ID NO: 661 - protein, 7 aa, Artificial Sequence
  Made in Lab - synthesized CDRL2 sequence of binders against hASGR1/2
WASTRES

SEQ ID NO: 662 - protein, 11 aa, Artificial Sequence
  Made in Lab - synthesized CDRL3 sequence of binders against hASGR1/2
CFQGSHVPPTF

SEQ ID NO: 663 - protein, 10 aa, Artificial Sequence
  Made in Lab - synthesized CDRL3 sequence of binders against hASGR1/2
CKQSYYLLTF

SEQ ID NO: 664 - protein, 11 aa, Artificial Sequence
  Made in Lab - synthesized CDRL3 sequence of binders against hASGR1/2
CLQATHQPWTF

SEQ ID NO: 665 - protein, 11 aa, Artificial Sequence
  Made in Lab - synthesized CDRL3 sequence of binders against hASGR1/2
CLQGTHQPLTF

SEQ ID NO: 666 - protein, 10 aa, Artificial Sequence
  Made in Lab - synthesized CDRL3 sequence of binders against hASGR1/2
CLQYDDLWTF

SEQ ID NO: 667 - protein, 11 aa, Artificial Sequence
  Made in Lab - synthesized CDRL3 sequence of binders against hASGR1/2
CLQYDEFPFTF

SEQ ID NO: 668 - protein, 11 aa, Artificial Sequence
  Made in Lab - synthesized CDRL3 sequence of binders against hASGR1/2
CLQYDEFPLTF

SEQ ID NO: 669 - protein, 11 aa, Artificial Sequence [sequence omitted]

SEQ ID NO: 670 - protein, 11 aa, Artificial Sequence [sequence omitted]

SEQ ID NO: 671 - protein, 12 aa, Artificial Sequence
  Made in Lab - synthesized CDRL3 sequence of binders against hASGR1/2
CNSRDRRGYSVF

SEQ ID NO: 672 - protein, 13 aa, Artificial Sequence
  Made in Lab - synthesized CDRL3 sequence of binders against hASGR1/2
CNSRKSSSKNVVF

SEQ ID NO: 673 - protein, 13 aa, Artificial Sequence
  Made in Lab - synthesized CDRL3 sequence of binders against hASGR1/2
CNSRLRSGKMVVF

SEQ ID NO: 674 - protein, 11 aa, Artificial Sequence
  Made in Lab - synthesized CDRL3 sequence of binders against hASGR1/2
CQHFWGSTWTF

SEQ ID NO: 675 - protein, 11 aa, Artificial Sequence
  Made in Lab - synthesized CDRL3 sequence of binders against hASGR1/2
CQHFWGTPFTF

SEQ ID NO: 676 - protein, 11 aa, Artificial Sequence
  Made in Lab - synthesized CDRL3 sequence of binders against hASGR1/2
CQHFWGTTWTF

SEQ ID NO: 677 - protein, 11 aa, Artificial Sequence
  Made in Lab - synthesized CDRL3 sequence of binders against hASGR1/2
CQHHYGTPYTF

SEQ ID NO: 678 - protein, 10 aa, Artificial Sequence
  Made in Lab - synthesized CDRL3 sequence of binders against hASGR1/2
CQHHYGTWTF

SEQ ID NO: 679 - protein, 7 aa, Artificial Sequence [sequence omitted]

SEQ ID NO: 680 - protein, 11 aa, Artificial Sequence [sequence omitted]

SEQ ID NO: 681 - protein, 11 aa, Artificial Sequence [sequence omitted]

SEQ ID NO: 682 - protein, 11 aa, Artificial Sequence
  Made in Lab - synthesized CDRL3 sequence of binders against hASGR1/2
CQQAYDFPLTF

SEQ ID NO: 683 - protein, 11 aa, Artificial Sequence [sequence omitted]

SEQ ID NO: 684 - protein, 11 aa, Artificial Sequence
  Made in Lab - synthesized CDRL3 sequence of binders against hASGR1/2
CQQGYTIPITF

SEQ ID NO: 685 - protein, 11 aa, Artificial Sequence [sequence omitted]

SEQ ID NO: 686 - protein, 11 aa, Artificial Sequence [sequence omitted]

SEQ ID NO: 687 - protein, 11 aa, Artificial Sequence
  Made in Lab - synthesized CDRL3 sequence of binders against hASGR1/2
CQQSNSWPLTF

SEQ ID NO: 688 - protein, 11 aa, Artificial Sequence [sequence omitted]

SEQ ID NO: 689 - protein, 11 aa, Artificial Sequence
  Made in Lab - synthesized CDRL3 sequence of binders against hASGR1/2
CQQTYAIPLTF

SEQ ID NO: 690 - protein, 11 aa, Artificial Sequence [sequence omitted]

SEQ ID NO: 691 - protein, 11 aa, Artificial Sequence [sequence omitted]

SEQ ID NO: 692 - protein, 11 aa, Artificial Sequence [sequence omitted]

SEQ ID NO: 693 - protein, 11 aa, Artificial Sequence
  Made in Lab - synthesized CDRL3 sequence of binders against hASGR1/2
CWQGTHFPHTF

SEQ ID NO: 694 - protein, 12 aa, Artificial Sequence
  Made in Lab - synthesized CDRL3 sequence of binders against hASGR1/2
NSLERIGYLSYV

SEQ ID NO: 695 - protein, 9 aa, Artificial Sequence
  Made in Lab - synthesized CDRL3 sequence of binders against hASGR1/2
QQWSGYPYT

SEQ ID NO: 696 - protein, 9 aa, Artificial Sequence
  Made in Lab - synthesized CDRL3 sequence of binders against hASGR1/2
WQGTHFPYT

SEQ ID NO: 697 - protein, 13 aa, Artificial Sequence
  Made in Lab - synthesized CDRH2 sequence of binders against hRNF43/ZNRF3
SYISRSSSTIYYA

SEQ ID NO: 698 - protein, 4 aa, Artificial Sequence
  Made in Lab - synthesized peptide linker
GGGG

SEQ ID NO: 699 - protein, 5 aa, Artificial Sequence
  Made in Lab - synthesized peptide linker
GGGGG

SEQ ID NO: 700 - protein, 7 aa, Artificial Sequence
  Made in Lab - synthesized peptide linker
GGGGGGG

SEQ ID NO: 701 - protein, 5 aa, Artificial Sequence
  Made in Lab - synthesized peptide linker
GGGGS

SEQ ID NO: 702 - protein, 6 aa, Artificial Sequence
  Made in Lab - synthesized peptide linker
GGGGGK

SEQ ID NO: 703 - protein, 7 aa, Artificial Sequence
  Made in Lab - synthesized peptide linker
GGGGGKR

SEQ ID NO: 704 - protein, 8 aa, Artificial Sequence
  Made in Lab - synthesized peptide linker
GGGKGGGG

SEQ ID NO: 705 - protein, 9 aa, Artificial Sequene
  Made in Lab - CDRH1
GFTFSHYTL

SEQ ID NO: 706 - protein, 17 aa, Artificial Sequene
  Made in Lab - CDRH2
VISGDGSYTYYADSVKG

SEQ ID NO: 707 - protein, 9 aa, Artificial Sequence
  MAde in Lab - CDRH3
NFIKYVFAN

SEQ ID NO: 708 - protein, 11 aa, Artificial Sequene
  Made in Lab - CDRL1
SGDKLGKKYAS

SEQ ID NO: 709 - protein, 11 aa, Artificial Sequene
  Made in Lab - CDRL1
SGDNIGSFYVH

SEQ ID NO: 710 - protein, 8 aa, Artificial Sequence
  MAde in Lab - CDRL2
EKDNRPSG

SEQ ID NO: 711 - protein, 8 aa, Artificial Sequence
  MAde in Lab - CDRL2
DKSNRPSG

SEQ ID NO: 712 - protein, 8 aa, Artificial Sequence
  MAde in Lab - CDRL3
SSFAGNSL

SEQ ID NO: 713 - protein, 8 aa, Artificial Sequence
  MAde in Lab - CDRL3
QSYANTLS

SEQ ID NO: 714 - protein, 90 aa, Homo sapiens
KMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 715 - protein, 88 aa, Homo sapiens
KMSHIKGHEGDPCLRSSDCIEGFCCARHFWTKICKPVLHQGEVCTKQRKKGSHGLEIFQRCDCAKGLSCKVWKDATYSSKARLHVCQK

The invention claimed is:

1. A tissue-specific Wnt ("Wingless-related integration site" or "Wingless and Int-1" or "Wingless-Int") signal enhancing molecule, or a pharmaceutically acceptable salt thereof, comprising a first domain that specifically binds one or more transmembrane E3 ubiquitin ligases selected from Zinc and Ring Finger 3 (ZNRF3) and Ring Finger Protein 43 (RNF43), and a second domain that specifically binds asialoglycoprotein receptor 1 (ASGR1), wherein:
 (a) the first domain comprises two R-spondin 2 polypeptides, or fragments thereof, each comprising the furin I domain of the R-spondin 2 polypeptide, wherein the R-spondin 2 polypeptides comprise amino acid substitutions at amino acids corresponding to F105 and F109 of the human R-spondin 2 of SEQ ID NO: 2; and/or
 (b) the second domain comprises an antibody or antigen-binding fragment thereof comprising:
  (i) a polypeptide comprising a heavy chain variable region comprising SEQ ID NO: 299; and
  (ii) a polypeptide comprising a light chain variable region comprising SEQ ID NO: 298.

2. The molecule of claim 1, wherein the molecule is a liver-specific Wnt signal enhancing molecule.

3. The molecule of claim 1, wherein the molecule comprises a fusion protein, wherein the fusion protein comprises one of the two R-spondin 2 polypeptides, or fragments thereof, of the first domain, and the polypeptide comprising the heavy chain variable region of the second domain or the polypeptide comprising the light chain variable region of the second domain, optionally linked via a linker moiety.

4. A nucleic acid sequence encoding for a polypeptide of the molecule of claim 1.

5. A pharmaceutical composition comprising:
 a) an effective amount of the molecule of claim 1; and
 b) a pharmaceutically acceptable diluent, adjuvant or carrier.

6. The pharmaceutical composition of claim 5, comprising the effective amount of the molecule of claim 1 and an effective amount of a Wnt polypeptide, a Norrin polypeptide, or a Wnt signaling agonist molecule.

7. A method for increasing Wnt ("Wingless-related integration site" or "Wingless and Int-1" or "Wingless-Int") signaling in a target tissue, comprising contacting the target tissue with:
 a) the molecule of claim 1, wherein the second domain specifically binds a cell-specific surface molecule on the target tissue, and wherein the molecule of claim 1 binds the target tissue and sequesters or increases endocytosis of one or more transmembrane E3 ubiquitin ligases selected from Zinc and Ring Finger 3 (ZNRF3) and Ring Finger Protein 43 (RNF43) in the target tissue; and/or b) a Wnt polypeptide, a Norrin polypeptide, or a Wnt signaling agonist molecule; a nucleic acid sequence that encodes a Wnt polypeptide, a Norrin polypeptide, or a Wnt signaling agonist molecule; a vector comprising a nucleic acid sequence that encodes a Wnt polypeptide, a Norrin polypeptide, or a Wnt signaling agonist molecule; or a host cell comprising an expression vector comprising a nucleic acid sequence that encodes a Wnt polypeptide, a Norrin polypeptide, or a Wnt signaling agonist molecule; wherein the nucleic acid sequence that encodes the Wnt polypeptide, the Norrin polypeptide, or the Wnt signaling agonist molecule is optionally DNA or mRNA, optionally a modified mRNA.

8. A method for treating a liver disease or liver condition in a subject in need thereof, wherein the liver disease or liver disorder is associated with reduced Wnt ("Wingless-related integration site" or "Wingless and Int-1" or "Wingless-Int") signaling or would benefit from increased Wnt signaling, comprising providing to the subject an effective amount of the pharmaceutical composition of claim 5, optionally wherein the molecule is the molecule of claim 2.

9. The method of claim 8, comprising providing to the subject a pharmaceutical composition comprising an effective amount of the molecule of claim 1 and a pharmaceutical composition comprising an effective amount of a Wnt polypeptide, a Norrin polypeptide, or a Wnt signaling agonist molecule.

10. A method for increasing liver to body weight ratio, promoting liver regeneration, increasing liver cell proliferation or mitosis, decreasing liver fibrosis, optionally following a chronic liver injury, increasing hepatocyte function, or decreasing coagulation time in liver, comprising providing to a subject an effective amount of the pharmaceutical composition of claim 5, wherein the antibody or antigen-binding fragment thereof binds to an ASGR1.

11. The molecule of claim 1, wherein the amino acid substitutions are F105R and F109A.

* * * * *